US010184117B2

(12) United States Patent
Nazor et al.

(10) Patent No.: US 10,184,117 B2
(45) Date of Patent: *Jan. 22, 2019

(54) BIOCATALYSTS AND METHODS FOR HYDROXYLATION OF CHEMICAL COMPOUNDS

(71) Applicant: Codexis, Inc., Redwood City, CA (US)

(72) Inventors: Jovana Nazor, Santa Clara, CA (US); Robert Osborne, Raleigh, NC (US); Jack Liang, San Mateo, CA (US); Jonathan Vroom, South San Francisco, CA (US); Xiyun Zhang, Fremont, CA (US); David Entwistle, San Carlos, CA (US); Rama Voladri, Milpitas, CA (US); Ravi David Garcia, Los Gatos, CA (US); Jeffrey C. Moore, Westfield, NJ (US); Shane Grosser, Princeton, NJ (US); Birgit Kosjek, Westfield, NJ (US); Matthew Truppo, Ocean Township, NJ (US)

(73) Assignee: Codexis, Inc., Redwood City, CA (US)

(*) Notice: Subject to any disclaimer, the term of this patent is extended or adjusted under 35 U.S.C. 154(b) by 0 days.

This patent is subject to a terminal disclaimer.

(21) Appl. No.: 15/491,692

(22) Filed: Apr. 19, 2017

(65) Prior Publication Data
US 2017/0355968 A1 Dec. 14, 2017

Related U.S. Application Data

(60) Provisional application No. 62/347,724, filed on Jun. 9, 2016.

(51) Int. Cl.
C12N 9/02 (2006.01)

(52) U.S. Cl.
CPC .......... C12N 9/0071 (2013.01); C12Y 114/11 (2013.01)

(58) Field of Classification Search
None
See application file for complete search history.

(56) References Cited

U.S. PATENT DOCUMENTS

| 5,364,775 | A | 11/1994 | Katsumata et al. |
| 5,605,793 | A | 2/1997 | Stemmer |
| 5,811,238 | A | 9/1998 | Stemmer et al. |
| 5,830,721 | A | 11/1998 | Stemmer et al. |
| 5,834,252 | A | 11/1998 | Stemmer et al. |
| 5,837,458 | A | 11/1998 | Minshull et al. |
| 5,854,040 | A | 12/1998 | Ozaki et al. |
| 5,928,905 | A | 7/1999 | Stemmer et al. |
| 5,962,292 | A | 10/1999 | Ozaki et al. |
| 5,963,254 | A | 10/1999 | Kim et al. |
| 6,096,548 | A | 8/2000 | Stemmer |
| 6,117,679 | A | 9/2000 | Stemmer |
| 6,132,970 | A | 10/2000 | Stemmer |
| 6,165,793 | A | 12/2000 | Stemmer |
| 6,180,406 | B1 | 1/2001 | Stemmer |
| 6,251,674 | B1 | 6/2001 | Tobin et al. |
| 6,277,638 | B1 | 8/2001 | Stemmer |
| 6,287,861 | B1 | 9/2001 | Stemmer et al. |
| 6,287,862 | B1 | 9/2001 | delCardayre et al. |
| 6,291,242 | B1 | 9/2001 | Stemmer |
| 6,297,053 | B1 | 10/2001 | Stemmer |
| 6,303,344 | B1 | 10/2001 | Patten et al. |
| 6,309,883 | B1 | 10/2001 | Minshull et al. |
| 6,319,713 | B1 | 11/2001 | Patten et al. |
| 6,319,714 | B1 | 11/2001 | Crameri et al. |
| 6,323,030 | B1 | 11/2001 | Stemmer |
| 6,326,204 | B1 | 12/2001 | delCardayre et al. |
| 6,335,160 | B1 | 1/2002 | Patten et al. |
| 6,335,198 | B1 | 1/2002 | delCardayre et al. |
| 6,344,356 | B1 | 2/2002 | Stemmer |
| 6,352,859 | B1 | 3/2002 | delCardayre et al. |
| 6,355,484 | B1 | 3/2002 | Patten et al. |
| 6,358,740 | B1 | 3/2002 | Patten et al. |
| 6,358,742 | B1 | 3/2002 | Stemmer |
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | delCardayre et al. |
| 6,387,702 | B1 | 5/2002 | Stemmer |
| 6,391,552 | B2 | 5/2002 | Stemmer |
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |
| 6,413,774 | B1 | 7/2002 | Stemmer |
| 6,420,175 | B1 | 7/2002 | Stemmer |
| 6,423,542 | B1 | 7/2002 | Crameri et al. |
| 6,426,224 | B1 | 7/2002 | Crameri et al. |
| 6,436,675 | B1 | 8/2002 | Welch et al. |
| 6,444,468 | B1 | 9/2002 | Stemmer et al. |
| 6,455,253 | B1 | 9/2002 | Patten et al. |
| 6,479,652 | B1 | 11/2002 | Crameri et al. |
| 6,482,647 | B1 | 11/2002 | Stemmer |
| 6,489,146 | B2 | 12/2002 | Stemmer et al. |

(Continued)

FOREIGN PATENT DOCUMENTS

| CN | 105177026 A | 12/2015 |
| EP | 0641862 B1 | 12/2001 |

(Continued)

OTHER PUBLICATIONS

Chica et al. Curr Opin Biotechnol. Aug. 2005;16(4):378-84. (Year: 2005).*

(Continued)

Primary Examiner — Christian L Fronda
(74) Attorney, Agent, or Firm — Codexis, Inc.

(57) ABSTRACT

The present invention provides engineered proline hydroxylase polypeptides for the production of hydroxylated compounds, polynucleotides encoding the engineered proline hydroxylases, host cells capable of expressing the engineered proline hydroxylases, and methods of using the engineered proline hydroxylases to prepare compounds useful in the production of active pharmaceutical agents.

5 Claims, 1 Drawing Sheet

Specification includes a Sequence Listing.

(56) References Cited

U.S. PATENT DOCUMENTS

| | | |
|---|---|---|
| 6,506,602 B1 | 1/2003 | Stemmer |
| 6,506,603 B1 | 1/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,716,631 B1 | 4/2004 | delCardayre et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,288,375 B2 | 10/2007 | Stemmer et al. |
| 7,421,347 B2 | 9/2008 | Selifonov et al. |
| 7,430,477 B2 | 9/2008 | Selifonov et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 8,383,346 B2 | 2/2013 | Colbeck et al. |
| 8,504,498 B2 | 8/2013 | Fox |
| 8,762,066 B2 | 6/2014 | Fox |
| 8,768,871 B2 | 7/2014 | Fox |
| 8,849,575 B2 | 9/2014 | Gustafsson et al. |
| 9,790,527 B2 * | 10/2017 | Chen .................. C12P 17/12 |
| 2006/0195947 A1 | 8/2006 | Davis et al. |
| 2008/0220990 A1 | 9/2008 | Fox |
| 2009/0312196 A1 | 12/2009 | Colbeck et al. |
| 2011/0046102 A1 | 2/2011 | Ledoussal et al. |
| 2011/0091942 A1 | 4/2011 | Kino et al. |
| 2015/0118719 A1 | 4/2015 | Chen et al. |

FOREIGN PATENT DOCUMENTS

| | | |
|---|---|---|
| EP | 2290065 B1 | 8/2014 |
| WO | 95/22625 A1 | 8/1995 |
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/008908 A2 | 1/2009 |
| WO | 2009/091856 A2 | 7/2009 |
| WO | 2009/102899 A1 | 8/2009 |
| WO | 2009/102901 A1 | 8/2009 |
| WO | 2009/139365 A1 | 11/2009 |
| WO | 2009/152336 A1 | 12/2009 |
| WO | 2010/126820 A2 | 11/2010 |
| WO | 2011/035105 A1 | 3/2011 |
| WO | 2013/003290 A1 | 1/2013 |
| WO | 2013/138339 A1 | 9/2013 |
| WO | 2013/169725 A2 | 11/2013 |
| WO | 2014/120819 A1 | 8/2014 |
| WO | 2014/120821 A1 | 8/2014 |
| WO | 2015/048573 A1 | 4/2015 |

OTHER PUBLICATIONS

Singh et al. Curr Protein Pept Sci. 2017, 18, 1-11 (Year: 2017).*
Sen et al. Appl Biochem Biotechnol. Dec. 2007;143(3):212-23. (Year: 2007).*
Accession Q92LF6. Dec. 1, 2001 (Year: 2001).*
Li et al. Biotechnol Bioeng. Jul. 2014;111(7):1273-87. Epub May 6, 2014. (Year: 2014).*
Alignment to Seq ID No. 226 of U.S. Pat. No. 9,790,527. Oct. 17, 2017. (Year: 2017).*
Adams, D.R., et al., "An efficient route to the alpha-methyl ester of L-glutamic acid, and its conversion into cis-5-hydroxy-L-pipecolic acid," Chem. Commun., 3:349-350 [1996].
Altamura, M., et al., "2-Substituted penems with amino acid-related side chains: synthesis and antibacterial activity of a new series of beta-lactam antibiotics," J Med Chem., 38(21):4244-56 [1995].
Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Baldino, Jr., F., et al., "High-Resolution in Situ Hybridization Histochemistry," Methods Enzymology, 168:761-777 (1989).
Batzer, M.A., "Erratum: Structure and variability of recently inserted Alu family members", Nucleic Acids Res 19:698-699 [1991].
Beaucage, S.L., et al., "Deoxynucleoside phosphoamidites—A new class of key intermediates for deoxypolynucleotide synthesis," Tetrahedron Letters, 22(20):1859-62 (1981).
Beyerman, H.C., et al., "Stereospecific synthesis and optical resolution of 5-hydroxypipecolic acid," Recueil des Travaux Chimiques des Pays-Bas, 78(9):648-658 [1959].
Black, M.E., et al., "Creation of drug-specific herpes simplex virus type 1 thymidine kinase mutants for gene therapy," Proc Natl Acad Sci USA, 93:3525-3529 (1996).
Bolton, E.T., et al., "A General Method for the Iisolation of RNA Complementary to DNA," Proc. Natl. Acad. Sci. USA 48:1390 (1962).
Botman, P.N., et al., "Diastereoselective synthesis of (2S,5R)-5-hydroxypipecolic acid and 6-substituted derivatives," Organic Letters, 6(26):4941-4944 [2004].
Botstein, D., et al., "Strategies and applications of in vitro mutagenesis," Science, 229(4719):1193-1201, 1985.
Breslauer, K.J., et al., "Predicting DNA duplex stability from the base sequence," Proc. Natl. Acad. Sci. USA, 83:3746-3750 (1986).
Caldwell, R.C., et al., "Mutagenic PCR," PCR Methods Appl., 3:S136-S140 (1994).
Callens, R.E.A., et al., "Preparation of Trans-5-Hydroxy-L-Pipecolic Acid and Cis-4-Hydroxy-L-Pipecolic Acid From L-Baikiain (1,2,5,6-L-Tetrahydropyridine-2-Carboxylic Acid)," Bulletin des Sociétés Chimiques Beiges, 91(8):713-723 [1982].
Carter, P., "Site-directed mutagenesis," Biochem. J., 237:1-7 (1986).
Chen, K.X., et al., "Novel potent hepatitis C virus NS3 serine protease inhibitors derived from proline-based macrocycles," J Med Chem., 49(3):995-1005 [2006].
Chen, K.X., et al., "Syntheses of novel 4-tert-alkyl ether proline-based 16- and 17-membered macrocyclic compounds," J Org Chem., 67(8):2730-3 [2002].
Chiou, W.H., et al., "Facile syntheses of enantiopure 3-hydroxypiperidine derivatives and 3-hydroxypipecolic acids," J Org Chem., 75(5):1748-51 [2010].
Christians, F.C., et al., "Directed evolution of thymidine kinase for AZT phosphorylation using DNA family shuffling," Nat. Biotechnol., 17:259-264 (1999).
Clark-Lewis, J.W., et al., "Occurrence of 4-hydroxypipecolic acid in *Acacia* species," Nature, 184(Suppl 16):1234-5 [1959].
Cohen, L.A., et al., "Synthesis of 5-Hydroxypipecolic Acid and Separation of Its Diastereoisomers," Science, 123(3202):842-843 [1956].

(56) References Cited

OTHER PUBLICATIONS

Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15(5):436-438 (1997).
Dale, S.J. et al., "Oligonucleotide-directed random mutagenesis using the phosphorothioate method," Methods Mol. Biol., 57:369-74 (1996).
De Boer, H.A., et al., "The tac promoter: A functional hybrid derived from the trp and lac promoters," Proc. Natl Acad. Sci. USA, 80: 21-25 (1983).
Efimov, V.A. et al., "Hydroxyproline-based DNA mimics provide an efficient gene silencing in vitro and in vivo," Nucleic Acids Res., 34(8):2247-2257 [2006].
Eguchi, C., et al., "The novel synthesis of L-Hydroxyproline from D-Glutamic Acid," Bull. Chem. Soc. Japan, 47(7):1704-08 [1974].
Fasman, G.D.,CRC Practical Handbook of Biochemistry and Molecular Biology, CRC Press, Boca Raton, FL, pp. 3-70 [1989].
Fowden, L., "Some observations on a hydroxypipecolic acid from thrift (*Armeria maritima*)," Biochem J., 70(4):629-33 [1958].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Hara, R., "Characterization of novel 2-oxoglutarate dependent dioxygenases converting L-proline to cis-4-hydroxy-l-proline," Biochem Biophys Res Commun., 379(4):882-6 [2009].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S.,et al., "Amino acid substitution matrices from protein blocks," Proc. Natl. Acad. Sci., 89:10915-10919 (1992).
Jourdant, A., et al., "An efficient stereoselective and stereodivergent synthesis of (2R,3R)- and (2R,3S)-3-hydroxypipecolic acids," Tetrahedron Lett., 41(36):7033-7036 [2000].
Kalamkar, N.B., et al., "Chiron approach to the synthesis of (2S,3R)-3-hydroxypipecolic acid and (2R,3R)-3-hydroxy-2-hydroxymethylpiperidine from D-glucose," J Org Chem., 73(9):3619-22 [2008].
Kierzek, R., et al., "Polymer-Supported RNA Synthesis and Its Application to Test the Nearest-Neighbor Model for Duplex Stability," Biochemistry, 25:7840-7846 (1986).
Klein, C., et al., "A Simple Procedure for Selective Hydroxylation of l-Proline and l-Pipecolic Acid with Recombinantly Expressed ProlineHydroxylases," Adv Synth. Catal., 353:1375-1383 [2011].
Koszelewski, D., et al., "Immobilization of omega-transaminases by encapsulation in a sol-gel/celite matrix," Journal of Molecular Catalysis B: Enzymatic, 63: 39-44 (2010).
Kramer, B., et al., "Different base/base mismatches are corrected with different efficiencies by the methyl-directed DNA mismatch-repair system of *E coil*," Cell, 38(3):879-887 [1984].
Kumar, P., et al., "Asymmetric synthesis of both the enantiomers of trans-3-hydroxypipecolic acid," J Org Chem., 70(1):360-3 [2005].
Lawrence, C.C., et al., "Purification and initial characterization of proline 4-hydroxylase from Streptomyces griseoviridus P8648: a 2-oxoacid, ferrous-dependent dioxygenase involved in etamycin biosynthesis," Biochem. J., 313:185-191 [1996].
Lee, Y.K., et al., "The novel synthesis of two diastereomers of gamma-hydroxyproline," Bull. Chem. Soc. Japan, 46:2924-26 [1973].
Lemire A., et al., "Stereoselective syntheses of L-pipecolic acid and (2S,3S)-3-hydroxypipecolic acid from a chiral N-imino-2-phenyl-1,2-dihydropyridine intermediate," J Org Chem., 75(6):2077-80 [2010].

Letavic, M.A., et al., "Synthesis and biological activity of selective pipecolic acid-based TNF-α converting enzyme (TACE) inhibitors," Bioorg Medicinal Chem Lett., 12(10):1387-1390 [2002].
Liang, N., et al., "Stereoselective total synthesis of cis- and trans-3-hydroxypipecolic acid," J Org Chem., 70(24):10182-5 [2005].
Ling, M., et al., "Approaches to DNA Mutagenesis:An Overview," Anal. Biochem., 254:157-78 (1997).
Majamaa, K., et al., "Differences between collagen hydroxylases and 2-oxoglutarate dehydrogenase in their inhibition by structural analogues of 2-oxoglutarate," Biochem. J., 229:127-133 [1985].
Marin, J., et al., "Synthesis of enantiopure 4-hydroxypipecolate and 4-hydroxylysine derivatives from a common 4,6-dioxopiperidinecarboxylate precursor," J Org Chem., 69(1):130-41 [2004].
Martin, A.R., et al., "Characterization of free and immobilized (S)-aminotransferase for acetophenone production," Applied Microbiology and Biotechnology, 76(4): 843-851 (2007).
Mateo, C., et al., "Epoxy sepabeads: a novel epoxy support for stabilization of industrial enzymes via very intense multipoint covalent attachment," Biotechnology Progress 18(3):629-34 (2002).
Matthes, H.W.D., et al., "Simultaneous rapid chemical synthesis of over one hundred oligonucleotides on a microscale," EMBO J., 3(4):801-05 (1984).
McInerney, J.O., "GCUA: general codon usage analysis," Bioinformatics, 14(4):372-73, 1998.
Minshull, J., et al., "Protein evolution by molecular breeding," Curr. Op. Chem. Biol., 3(3):284-290 (1999).
Mori, H., et al., "Detection of Novel Proline 3-Hydroxylase Activities in *Streptomyces* and *Bacillus* spp. by Regio- and Stereospecific Hydroxylation of l-Proline," Appl. Environ. Microbiol., 62:1903-1907 [1996].
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
O'Connell, C.E., et al., "Synthesis and evaluation of some hydroxyproline-derived peptidomimetics as isoprenyltransferase inhibitors" Chem Pharm Bull., 48(5):740-742 [2000].
Pearson, W.R., "Improved tools for biological sequence comparison," Proc. Nat'l. Acad. Sci. USA, 85:2444-2448 (1988).
Petersen, L. et al., "Novel proline hydroxylase activities in the pneumocandin-producing fungus *Glarea lozoyensis* responsible for the formation of trans 3- and trans 4-hydroxyproline," Appl Microbiol Biotechnol., 62(2-3):263-7 [2003].
Ramaswarmy, S.G., et al., "One-vessel synthesis of 4-hydroxyproline from glyoxal and oxaloacetic acid," J. Org. Chem., 42(21):3440-3443 [1977].
Remuzon, P., "Trans-4-hydroxy-L-proline, a useful and versatile chiral starting block," Tetrahedron, 52(44):13803-13835 [1996].
Romanos, M.A., et al., "Foreign gene expression in yeast: a review," Yeast 8:423-488 [1992].
Romeo, J.T., et al., "Cis-4-Hydroxypipecolic Acid and 2,4-Cis-4,5-Trans-4,5-Dihydroxypipecolic Acid From Calliandra," Phytochemistry 22(7):1615-1617 [1983].
Rychlik, W., et al., "Optimization of the annealing temperature for DNA amplification in vitro," Nucleic Acids Res, 18(21):6409-6412 (1990).
Shibasaki, T., et al., "Microbial Proline 4-Hydroxylase Screening and Gene Cloning," Appl. Environ. Microbiol, 65 (9):4028-31 [1999].
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stellwagen, E., "Dye Affinity Chromatography," Current Protocols in Protein Science, Chapter 9, Unit 9.2-9.2.16 [2001].
Stemmer, W., "DNA Shuffling by Random Fragmentation and Reassembly: In vitro Recombination for Molecular Evolution," Proc. Natl. Acad. Sci. USA, 91:10747-10751 (1994).

(56) References Cited

OTHER PUBLICATIONS

Stemmer, W.P.C., "Rapid evolution of a protein in vitro by DNA shuffling", Nature, 370:389-391 (1994).

Stenico, M., et al., "Codon usage in Caenorhabditis elegans: delineation of translational selection and mutational biases," Nucl. Acids Res. 22(13):2437-46 [1994].

Suggs, S.V., et al., "Use of synthetic oligodeoxyribonucleotides for the isolation of specific cloned DNA sequenes," In Developmental Biology Using Purified Genes (Brown et al., eds.), pp. 683-693, Academic Press (1981).

Tiwari, S., et al., "Prediction of probable genes by Fourier analysis of genomic sequences," Comput. Appl. Biosci. 13(3):263-270 [1997].

Truppo, M.D., et al., "Development of an Improved Immobilized CAL-B for the Enzymatic Resolution of a Key Intermediate to Odanacatib," Organic Process Research & Development, 15:1033-1035 (2011).

Uberbacher, E.G., et al., "Discovering and Understanding Genes in Human DNA Sequence Using GRAIL," Methods Enzymol., 266:259-281 [1996].

Vergnon, A.L., et al., "Solid-phase synthesis of a library of hydroxyproline derivatives," J Comb Chem., 6(1):91-8 [2004].

Villa-Komaroff, L., et al., "A bacterial clone synthesizing proinsulin," Proc. Natl Acad. Sci. USA, 75:3727-3731 (1978).

Wada, K., et al., "Codon usage tabulated from the GenBank genetic sequence data," Nucl. Acids Res., 20:2111-2118 [1992].

Wells, J.A., et al., "Cassette mutagenesis: an efficient method for generation of multiple mutations at defined sites," Gene, 34:315-323 (1985).

Wetmur, J. G., "DNA Probes: Applications of the Principles of Nucleic Acid Hybridization," Crit Rev Biochem Mol Biol, 26(3/4):227-259 (1991).

Wright, F., "The 'effective number of codons' used in a gene," Gene 87:23-29 [1990].

Yaegaki, K., et al., "Improved high-performance liquid chromatography method for quantitation of proline and hydroxyproline in biological materials," J Chromatogr., 356(1):163-70 [1986].

Yi, S., et al., "Covalent immobilization of omega-transaminase from Vibrio fluvialis JS17 on chitosan beads," Process Biochemistry 42(5): 895-898 (2007).

Zhang, J-H., et al., "Directed evolution of a fucosidase from a galactosidase by DNA shuffling and screening,"Proc. Nat. Acad. Sci., U.S.A., 94:4504-4509 (1997).

Zhao, H., et al., "Molecular evolution by staggered extension process (StEP) in vitro recombination," Nat. Biotechnol., 16:258-261 (1998).

\* cited by examiner

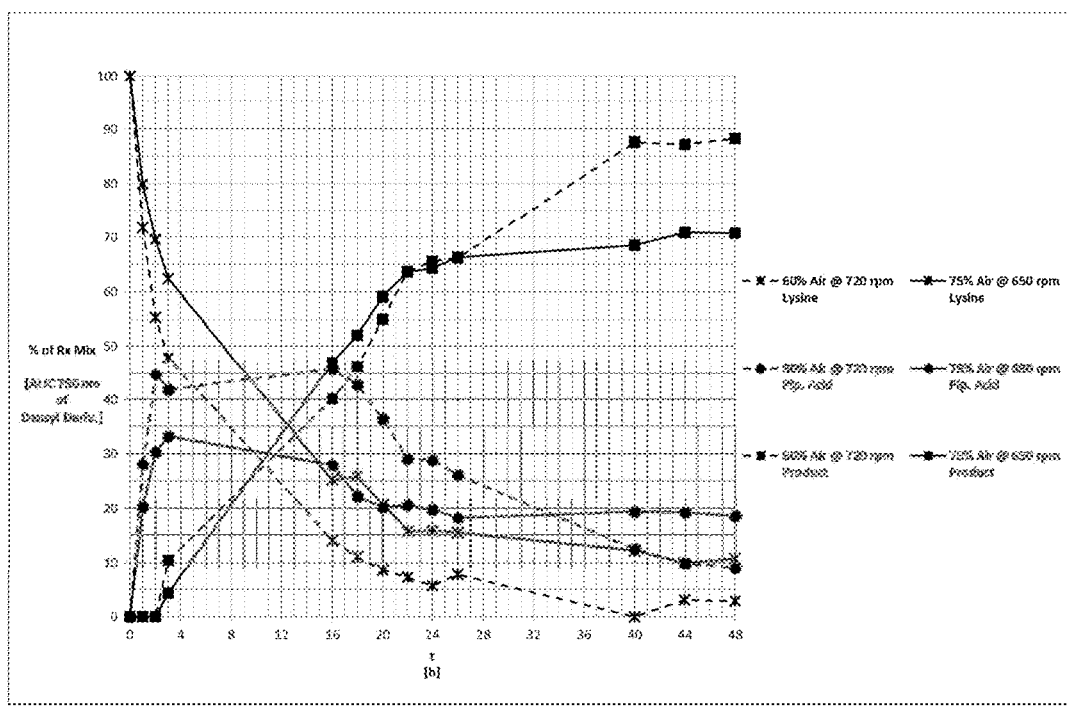

BIOCATALYSTS AND METHODS FOR HYDROXYLATION OF CHEMICAL COMPOUNDS

The present application claims priority to U.S. Prov. Pat. Appln. Ser. No. 62/347,724, filed Jun. 9, 2016, hereby incorporated by reference in its entirety for all purposes.

TECHNICAL FIELD

The invention relates to biocatalysts for the hydroxylation of chemical compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-153USP1_ST25.txt", a creation date of Jun. 9, 2016, and a size of 1,888,256 bytes. The Sequence Listing filed via EFS-Web is part of the specification and is incorporated in its entirety by reference herein.

BACKGROUND

Proline derivatives with functional groups on the ring carbons are useful building blocks for synthesis of pharmaceutical compounds because of the constrained conformation of proline. One such derivative, hydroxylated proline, is a starting material for the synthesis of various therapeutic compounds, including carbapenem antibiotics (See e.g., Altamura et al., J. Med., Chem. 38(21):4244-56 [1995]), angiotensin-converting enzyme inhibitors, protease inhibitors (See e.g., Chen et al., J. Org. Chem., 67(8):2730-3 [2002]; Chen et al., 2006, J Med Chem. 49(3):995-1005), nucleic acid analogs (See e.g., Efimov et al., Nucleic Acids Res., 34(8):2247-2257 [2006]), isoprenyltransferase inhibitors (O'Connell et al., Chem. Pharm. Bull., 48(5):740-742 [2000]), and drug library construction (Vergnon et al., J. Comb. Chem., 6(1):91-8 [2004]; and Remuzon, Tetrahedron 52:13803-13835 [1996]). Similarly, hydroxylated derivatives of a proline homolog, L-pipecolic acid, also known as homoproline, also serve as building blocks for pharmaceutical compounds. For example, hydroxypipecolic acid is an intermediate in the synthesis of β-lactamase inhibitors (See e.g., WO2009091856, WO2010126820 and US20110046102) and TNF-alpha converting enzyme (TACE) inhibitors (Levatic et al., Bioorg. Med. Chem. Lett., 12(10):1387-1390 [2002]).

Hydroxyproline can be obtained from natural sources, such as plant materials and hydrolyzates of collagen. Hydroxyproline can also be chemically synthesized, such as from starting materials allyl bromide and diethylacetamidomalonic acid (Kyun Lee et al., Bull. Chem. Soc. Japan, 46:2924 [1973]), D-glutamic acid (Eguchi et al., Bull. Chem. Soc. Japan, 47:1704-08 [1974]), glyoxal and oxaloacetic acid (Ramaswamy et al., J. Org. Chem., 42(21):3440-3443 [1977]), and α-alanine (Sinha et al., Proc. ECSOC-4, The Fourth International Electronic Conference on Synthetic Organic Chemistry, ISBN 3-906980-05-7 [2000]).

Hydroxyipecolic acid can also be obtained from plants and other natural sources (See e.g., Romeo et al., Phytochem., 22(7):1615-1617 [1983]; Fowden, Biochem. J., 70(4):629-33 [1958]; and Clark-Lewis and Mortimer, Nature 184(Suppl 16):1234-5 [1959]). Chemical synthesis of hydroxypipecolic acid is also known in the art (See e.g., Callens et al., Bulletin des Sociétés Bulletin des Sociétés Chimiques Beiges 91(8):713-723 [2010]; Adams et al., Chem. Commun., 3:349-350 [1996]; Botman et al., Org. Lett., 6(26):4941-4944 [2004]; Cohen et al., Science 123 (3202):842-843 [1956]; Beyerman et al., Recueil des Travaux Chimiques des Pays-Bas, 78(9):648-658 [1959]; Marin et al., J. Org. Chem., 69(1):130-41 [2004]; Kumar et al., J. Org. Chem., 70(1):360-3 [2005]; Liang et al., J. Org. Chem., 70(24):10182-5 [2005]; Kalamkar et al., J. Org. Chem., 73(9):3619-22 [2008]; Chiou et al., J. Org. Chem., 75(5):1748-51 [2010]; Lemire et al., J. Org. Chem., 75(6): 2077-80 [2010]; and Angelique et al., Tetrahedron Lett., 41(36):7033-7036 [2000]).

Isolation from natural sources is limited by the availability of raw materials, requires purification from a significant amount of background contaminants, and lacks certain desired diastereomers. Chemical synthetic methods can require complex steps, be difficult to scale up to industrial scale levels, and require additional purification steps due to formation of multiple hydroxylated products.

Another approach for preparing hydroxylated proline uses proline hydroxylases, which are 2-oxoglutarate-dependent dioxygenases, utilizing 2-oxoglutarate (α-ketoglutarate) and $O_2$ as co-substrates and ferrous ion as a cofactor (See e.g., Klein et al., Adv. Synth. Catal., 353:1375-1383 [2011]; U.S. Pat. No. 5,364,775; and Shibasaki et al., Appl. Environ. Microbiol., 65(9):4028-4031 [1999]) Unlike prolyl hydroxylases that specifically recognize peptidyl proline in procollagen and related peptides, proline hydroxylases are capable of converting free proline to hydroxyproline. Several microbial enzymes that produce cis-3-, cis-4- or trans-4-hydroxyproline are known in the art (See e.g., U.S. Pat. Nos. 5,962,292, 5,963,254, and 5,854,040; WO2009139365; and EP2290065) and an enzyme that produces trans-3-hydroxyproline has been identified in extracts of the fungus *Glarea lozoyensis*. Many of the proline hydroxylases are found in bacteria, where they are associated with the biosynthesis of peptide antibiotics. The cis-4-proline hydroxylase enzyme also shows activity in converting L-pipecolic acid (i.e., (2S)-piperidine-2-carboxylic acid) to cis-5-hydroxypipecolic acid (i.e., (2S,5S)-5-hydroxypiperidine-2-carboxylic acid; Klein et al., supra). In vitro conversions for preparing 5-hydroxypipecolic acid using these enzymes have been demonstrated, but isolated proline hydroxylases are found to denature under reaction conditions and have relatively low specific activity, rendering in vitro uses impracticable for commercial applications (Klein et al., supra). While recombinant whole cells expressing cloned proline hydroxylases are better suited for large scale industrial processes, the use of whole cells limits variations in reaction conditions, such as high substrate concentrations; restricts the types of substrates that can be used to those that are permeable to the cells; and results in undesirable by-products that must be separated from the final product. In addition, in vivo systems may require defined growth media that are not optimal or cost effective because the use of rich growth media prepared from protein hydrolyzates contain free proline, which can be a competitive inhibitor when substrates other than proline are being targeted. Desirable are alternative methods for synthesizing hydroxylated forms of proline and proline analogs, as well as other chemical compounds, that can be readily scaled up and result in substantially pure stereometric product.

SUMMARY OF THE INVENTION

The present invention provides engineered proline hydroxylase biocatalysts, polynucleotides encoding the biocatalysts, methods of their preparation, and processes for preparing hydroxylated compounds using these engineered biocatalysts. The proline hydroxylases of the present invention have been engineered to have one or more improved properties relative to the naturally occurring cis-4-proline hydroxylase (SEQ ID NO:2) of *Sinorhizobium meliloti*, a nitrogen fixing Gram negative bacterium. The improved biocatalyst properties of the engineered proline hydroxylases include, among others, activity, regioselectivity, substrate tolerance, and stability. The engineered proline hydroxylases have also been found to hydroxylate a variety of substrate compounds, including the hydroxylation of (S)-pipecolic acid into (2S,5S)-5-hydroxypipecolic acid using alpha-ketoglutarate as a co-substrate. In some embodiments, the process is conducted in the presence of oxygen (i.e., air) and iron (i.e., Fe(II)).

The engineered enzymes with improved properties have one or more residue differences as compared to the naturally occurring proline hydroxylase, where the residue differences occur at residue positions affecting one or more of the foregoing enzyme properties.

Accordingly, in one aspect, the present invention provides engineered polypeptides having proline hydroxylase activity, where the polypeptides comprises an amino acid sequence having at least about 80% identity to SEQ ID NO:4, 604, and/or 810. In some embodiments, the present invention provides engineered polypeptides having proline hydroxylase activity, wherein the polypeptides comprise an amino acid sequence set forth in the even-numbered sequences in the range of SEQ ID NO:4-1004. The following detailed description provides guidance on the choices of the residue differences that can be used to prepare engineered proline hydroxylases with the desired improved biocatalytic properties.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:4. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:4, and one or more residue differences as compared to SEQ ID NO:4 at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:6-1004. In some further embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:6-646, and 810.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:604. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:604, and one or more residue differences as compared to SEQ ID NO:604 at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:6-1004. In some further embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:640-982.

The present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:810. In some embodiments, the present invention provides engineered polypeptides having proline hydroxylase activity comprising amino acid sequences having at least 80%, 85%, 86%, 87%, 88%, 89%, 90%, 91%, 92%, 93%, 94%, 95%, 96%, 97%, 98%, 99% or more sequence identity to SEQ ID NO:810, and one or more residue differences as compared to SEQ ID NO:810 at residue positions selected from 33, 40, 95, and 156. In some embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:6-1004. In some further embodiments, the engineered polypeptide has at least 80%, 85%, 86%, 87%, 88%, 89%, 90%, 91%, 92%, 93%, 94%, 95%, 96%, 97%, 98%, 99% or more sequence identity to at least one of the even-numbered sequences in SEQ ID NOS:984-1004.

The present invention also provides engineered polypeptides having proline hydroxylase activity capable of converting (S)-pipecolic acid to (2S,5S)-5-hydroxypipecolic acid. In some embodiments, the engineered polypeptide is capable of converting (S)-pipecolic acid to (2S,5S)-5-hydroxypipecolic acid with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold or more the activity of the naturally occurring enzyme. In some further embodiments, the engineered polypeptide is capable of converting (S)-pipecolic acid to (2S,5S)-5-hydroxypipecolic acid with greater than 90%, 91%, 92%, 93%, 94%, 95%, 96%, 97%, 98%, 99% or more diastereomeric excess of (2S,5S)-5-hydroxypipecolic acid.

The present invention also provides polynucleotides encoding the engineered polypeptide having proline hydroxylase activity. In some embodiments, the polynucleotide comprises a nucleic acid sequence optimized for expression in *E. coli*.

The present invention further provides expression vectors comprising the polynucleotides encoding the engineered polypeptide having proline hydroxylase activity. In some embodiments, the expression vectors comprise at least one control sequence. In some further embodiments, the expression vector comprises SEQ ID NO:1007, 1008, or 1009.

The present invention also provides host cells comprising the polynucleotide encoding engineered polypeptides having proline hydroxylase activity. In some embodiments, the host cell is E. coli.

The present invention further provides methods of preparing engineered polypeptides having proline hydroxylase activity, comprising culturing the host cell comprising an expression vector comprising at least one polynucleotide encoding an engineered polypeptide having proline hydroxylase activity under conditions suitable for expression of the polypeptide(s). In some embodiments, the methods further comprise the step of isolating the engineered polypeptide(s).

DESCRIPTION OF THE FIGURES

FIG. 1 provides a graph showing the results of the "one pot" synthesis reaction from lysine described in Example 7.

DESCRIPTION OF THE INVENTION

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention.

The section headings used herein are for organizational purposes only and not to be construed as limiting the subject matter described.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations

The abbreviations used for the genetically encoded amino acids are conventional and are as follows:

| Amino Acid | Three-Letter Abbreviation | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | HIS | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about $\alpha$-carbon ($C_\alpha$). For example, whereas "Ala" designates alanine without specifying the configuration about the $\alpha$-carbon, "D-Ala" and "L-Ala" designate D-alanine and L-alanine, respectively. When the one-letter abbreviations are used, upper case letters designate amino acids in the L-configuration about the $\alpha$-carbon and lower case letters designate amino acids in the D-configuration about the $\alpha$-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleosides that are covalently linked together. The polynucleotide may be wholly comprised of ribonucleotides (i.e., RNA), wholly comprised of 2' deoxyribonucleotides (i.e., DNA) or mixtures comprised of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

"Coding sequence" refers to that portion of a nucleic acid (e.g., a gene) that encodes an amino acid sequence of a protein.

"Proline hydroxylase" refers to a polypeptide having an enzymatic capability of converting free proline to hydroxyproline in presence of co-substrate α-ketoglutarate and dioxygen, as illustrated below:

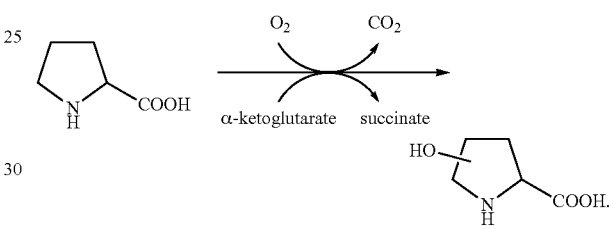

It is to be understood that proline hydroxylases are not limited to the foregoing reaction with proline, but may hydroxylate other substrates, for example pipecolic acid. Proline hydroxylases as used herein include naturally occurring (wild-type) proline hydroxylase as well as non-naturally occurring engineered polypeptides generated by human manipulation. In some embodiments, the proline hydroxylase variants of the present invention are capable of converting (S)-pipecolic acid (i.e., compound I) to (2S,5S)-5-hydroxypipecolic acid (i.e., compound II), as shown in Scheme 1, below:

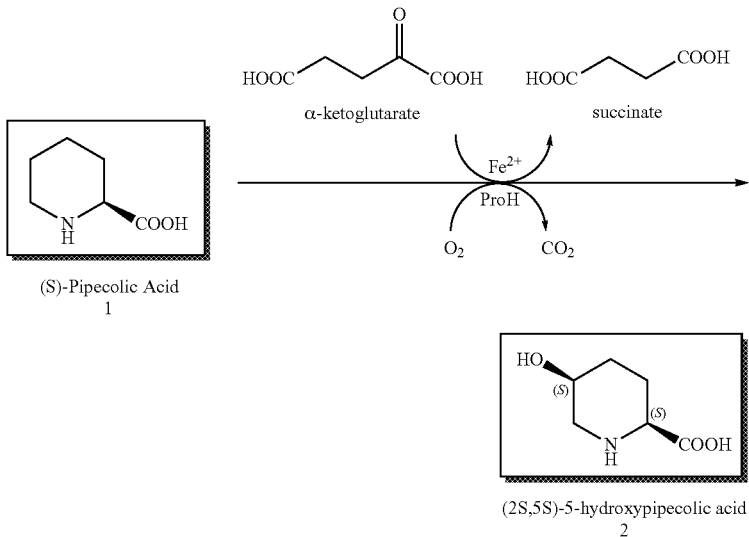

"Co-substrate" of a proline hydroxylase refers to α-ketoglutarate and co-substrate analogs that can replace α-ketoglutarate in hydroxylation of proline and proline substrate analogs. Co-substrate analogs include, by way of example and not limitation, 2-oxoadipate (See e.g., Majamaa et al., Biochem. J., 229:127-133 [1985]).

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences.

The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered proline hydroxylase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, or at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO:4" refers to a difference in the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" refers to an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than that in the reference polypeptide). In some instances (e.g., in Tables 4.1, 4.2, 4.3, 4.4, 4.5, 4.6, 4.7, 4.8, 5.1, 6.1, 6.2, and 6.3), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention comprises one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered proline hydroxylase enzyme. Deletions can be directed to the internal portions and/or terminal portions of the polypeptide. In various embodiments, the deletion can comprise a continuous segment or can be discontinuous.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered proline hydroxylase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant proline hydroxylase polypeptides may be present within a cell, present in the cellular medium, or prepared in various forms, such as lysates or isolated preparations. As such, in some embodiments, the recombinant proline hydroxylase polypeptides can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising proline hydroxylase comprises proline hydroxylase that is less than 50% pure (e.g., about 10%, about 20%, about 30%, about 40%, or about 50%) Generally, a substantially pure proline hydroxylase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant proline hydroxylase polypeptides are substantially pure polypeptide compositions.

As used herein, "improved enzyme property" refers to at least one improved property of an enzyme. In some embodiments, the present invention provides engineered proline hydroxylase polypeptides that exhibit an improvement in any enzyme property as compared to a reference proline hydroxylase polypeptide, and/or a wild-type proline hydroxylase polypeptide and/or another engineered proline hydroxylase polypeptide. Thus, the level of "improvement" can be determined and compared between various proline hydroxylase enzymes, including wild-type, as well as engineered proline hydroxylases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to basic pH, increased tolerance to proteolytic activity (i.e., reduced sensitivity to proteolysis), reduced aggregation, increased solubility, and altered temperature profile.

As used herein, "increased enzymatic activity" and "enhanced catalytic activity" refer to an improved property of the engineered proline hydroxylase polypeptides, which can be represented by an increase in specific activity (e.g., product produced/time/weight protein) or an increase in percent conversion of the substrate to the product (e.g., percent conversion of starting amount of substrate to product in a specified time period using a specified amount of proline hydroxylase) as compared to the reference proline hydroxylase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring proline hydroxylase or another engineered proline hydroxylase from which the proline hydroxylase polypeptide was derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a proline hydroxylase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides proline hydroxylase variants with generalist properties, in that they demonstrate similar or improved activity relative to the parental gene for a wide range of sterically and electronically diverse substrates. In addition, the generalist enzymes provided herein were engineered to be improved across a wide range of diverse API-like molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc.

Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, Mass. [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered proline hydroxylase enzyme of the present invention.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the proline hydroxylase enzymes may be codon optimized for optimal production in the host organism selected for expression.

"Preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

"Control sequence" refers herein to include all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, substrate loading, temperature, pH, buffers, co-solvents, etc.) under which a proline hydroxylase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the proline hydroxylase polypeptide.

As used herein, "product" in the context of an enzymatic conversion process refers to the compound or molecule resulting from the action of the proline hydroxylase polypeptide on a substrate.

As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as E. coli, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. No. 6,117,679; U.S. Pat. No. 6,420,175; U.S. Pat. No. 6,376,246; U.S. Pat. No. 6,586,182; U.S. Pat. No. 7,747,391; U.S. Pat. No. 7,747,393; U.S. Pat. No. 7,783,428; and U.S. Pat. No. 8,383,346. After the variants are produced, they can be screened for any desired property (e.g., high or increased activity, or low or reduced activity, increased thermal activity, increased thermal stability, and/or acidic pH stability, etc.). In some embodiments, "recombinant proline hydroxylase polypeptides" (also referred to herein as "engineered proline hydroxylase polypeptides," "variant proline hydroxylase enzymes," and "proline hydroxylase variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the proline hydroxylase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited to, homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereometric excess.

"Highly stereoselective" refers to a chemical or enzymatic reaction that is capable of converting a substrate (e.g., compound (1)), to its corresponding hydroxylated product (e.g., compound (2)), with at least about 85% stereometric excess.

"Regioselectivity" or "regioselective reaction" refers to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites, for example, preferential formation of the product compound (2) (i.e., 2S,3S0-hydroxypipecolic acid over the undesired product (2S,5S)-hydroxypipecolic acid).

As used herein, "thermostable" refers to a proline hydroxylase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a proline hydroxylase polypeptide that maintains similar activity (more than e.g., 60% to 80%) after exposure to varying concentrations (e.g., 5-99%) of solvent (e.g., ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a proline hydroxylase polypeptide that is both thermostable and solvent stable.

As used herein, "reductant" refers to a compound or agent capable of converting $Fe^{+3}$ to $Fe^{+2}$. An exemplary reductant is ascorbic acid, which is generally in the form of L-ascorbic acid.

"Alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., $(C_1-C_6)$alkyl refers to an alkyl of 1 to 6 carbon atoms).

"Alkenyl" refers to hydrocarbon groups of from 2 to 12 carbon atoms inclusively, either straight or branched containing at least one double bond but optionally containing more than one double bond.

"Alkynyl" refers to hydrocarbon groups of from 2 to 12 carbon atoms inclusively, either straight or branched containing at least one triple bond but optionally containing more than one triple bond, and additionally optionally containing one or more double bonded moieties.

"Alkylene" refers to a straight or branched chain divalent hydrocarbon radical having from 1 to 18 carbon atoms inclusively, more preferably from 1 to 8 carbon atoms inclusively, and most preferably 1 to 6 carbon atoms inclusively, optionally substituted with one or more suitable substituents. Exemplary "alkylenes" include, but are not limited to, methylene, ethylene, propylene, butylene, and the like.

"Alkenylene" refers to a straight or branched chain divalent hydrocarbon radical having 2 to 12 carbon atoms inclusively and one or more carbon-carbon double bonds, more preferably from 2 to 8 carbon atoms inclusively, and most preferably 2 to 6 carbon atoms inclusively, optionally substituted with one or more suitable substituents.

"Heteroalkyl, "heteroalkenyl," and heteroalkynyl," refer respectively, to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NR$^\gamma$—, —PH—, —S(O)—, —S(O)$_2$—, —S(O)NR$^\gamma$—, —S(O)$_2$NR$^\gamma$—, and the like, including combinations thereof, where each R$^\gamma$ is independently selected from hydrogen, alkyl, cycloalkyl, heterocycloalkyl, aryl, and heteroaryl.

"Aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

"Arylalkyl" refers to an alkyl substituted with an aryl (i.e., aryl-alkyl- groups), preferably having from 1 to 6 carbon atoms inclusively in the alkyl moiety and from 6 to 12 carbon atoms inclusively in the aryl moiety. Such arylalkyl groups are exemplified by benzyl, phenethyl and the like.

"Aryloxy" refers to —OR$^\lambda$ groups, where R$^\lambda$ is an aryl group, which can be optionally substituted.

"Cycloalkyl" refers to cyclic alkyl groups of from 3 to 12 carbon atoms inclusively having a single cyclic ring or multiple condensed rings which can be optionally substituted with from 1 to 3 alkyl groups. Exemplary cycloalkyl groups include, but are not limited to, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Cycloalkylalkyl" refers to an alkyl substituted with a cycloalkyl (i.e., cycloalkyl-alkyl- groups), preferably having from 1 to 6 carbon atoms inclusively in the alkyl moiety and from 3 to 12 carbon atoms inclusively in the cycloalkyl moiety. Such cycloalkylalkyl groups are exemplified by cyclopropylmethyl, cyclohexylethyl and the like.

"Amino" refers to the group —NH$_2$. Substituted amino refers to the group —NHR$^\eta$, NR$^\eta$R$^\eta$, and NR$^\eta$R$^\eta$R$^\eta$, where each R$^\eta$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylysulfonylamino, furanyl-oxy-sulfamino, and the like.

"Aminoalkyl" refers to an alkyl group in which one or more of the hydrogen atoms are replaced with one or more amino groups, including substituted amino groups.

"Aminocarbonyl" refers to —C(O)NH$_2$. Substituted aminocarbonyl refers to —C(O)NR$^\eta$R$^\eta$, where the amino group NR$^\eta$R$^\eta$ is as defined herein.

"Oxy" refers to a divalent group —O—, which may have various substituents to form different oxy groups, including ethers and esters.

"Alkoxy" or "alkyloxy" are used interchangeably herein to refer to the group —OR$^\xi$, wherein R$^\xi$ is an alkyl group, including optionally substituted alkyl groups.

"Carboxy" refers to —COOH.

"Carbonyl" refers to —C(O)—, which may have a variety of substituents to form different carbonyl groups including acids, acid halides, aldehydes, amides, esters, and ketones.

"Carboxyalkyl" refers to an alkyl in which one or more of the hydrogen atoms are replaced with one or more carboxy groups.

"Aminocarbonylalkyl" refers to an alkyl substituted with an aminocarbonyl group, as defined herein.

"Halogen" or "halo" refers to fluoro, chloro, bromo and iodo.

"Haloalkyl" refers to an alkyl group in which one or more of the hydrogen atoms are replaced with a halogen. Thus, the term "haloalkyl" is meant to include monohaloalkyls, dihaloalkyls, trihaloalkyls, etc. up to perhaloalkyls. For example, the expression "$(C_1-C_2)$ haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl group in which in which one or more of the hydrogen atoms are replaced with one or more hydroxy groups.

"Thiol" or "sulfanyl" refers to —SH. Substituted thiol or sulfanyl refers to —S—$R^\eta$, where $R^\eta$ is an alkyl, aryl or other suitable substituent.

"Alkylthio" refers to —$SR^\xi$, where $R^\xi$ is an alkyl, which can be optionally substituted. Typical alkylthio group include, but are not limited to, methylthio, ethylthio, n-propylthio, and the like.

"Alkylthioalkyl" refers to an alkyl substituted with an alkylthio group, —$SR^\xi$, where $R^\xi$ is an alkyl, which can be optionally substituted.

"Sulfonyl" refers to —$SO_2$—. Substituted sulfonyl refers to —$SO_2$—$R^\eta$, where $R^\eta$ is an alkyl, aryl or other suitable substituent.

"Alkylsulfonyl" refers to —$SO_2$—$R^\xi$, where $R^\xi$ is an alkyl, which can be optionally substituted. Typical alkylsulfonyl groups include, but are not limited to, methylsulfonyl, ethylsulfonyl, n-propylsulfonyl, and the like.

"Alkylsulfonylalkyl" refers to an alkyl substituted with an alkylsulfonyl group, —$SO_2$—$R^\xi$, where $R^\xi$ is an alkyl, which can be optionally substituted.

"Heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

"Heteroarylalkyl" refers to an alkyl substituted with a heteroaryl (i.e., heteroaryl-alkyl- groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

"Heterocycle", "heterocyclic" and interchangeably "heterocycloalkyl" refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Heterocycloalkylalkyl" refers to an alkyl substituted with a heterocycloalkyl (i.e., heterocycloalkyl-alkyl-groups), preferably having from 1 to 6 carbon atoms inclusively in the alkyl moiety and from 3 to 12 ring atoms inclusively in the heterocycloalkyl moiety.

"Membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

"Fused bicyclic ring" as used herein refers to both unsubstituted and substituted carbocyclic and/or heterocyclic ring moieties having 5 to 8 atoms in each ring, the rings having 2 common atoms.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

"Optional" or "optionally" means that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

Engineered Proline Hydroxylase Polypeptides

The present invention provides polypeptides having proline hydroxylase activity, polynucleotides encoding the polypeptides, methods of preparing the polypeptides, and methods for using the polypeptides. Where the description relates to polypeptides, it is to be understood that it can describe the polynucleotides encoding the polypeptides.

Proline hydroxylases belong to a class of diooxygenase enzymes that catalyze hydroxylation of proline in presence of alpha-ketoglutarate and oxygen ($O_2$). The alpha-ketoglutarate is stoichiometrically decarboxylated during hydroxylation, with one atom of the $O_2$ molecule being incorporated into the succinate and the other into the hydroxyl group formed on the proline residue. As noted above, proline hydroxylases are distinguished from prolyl hydroxylase by their ability to hydroxylate free proline.

Several types of proline hydroxylases have been identified based on the major diastereomeric products formed in the enzymatic reaction: cis-3-proline hydroxylase (cis-P3H), cis-4-proline hydroxylase (cis-P4H), trans-3-proline hydroxylase (trans-P3H), and trans-4-proline hydroxylase (trans-P4H). cis-P3H enzymes have been identified in *Streptomyces* sp. TH1, *Streptomyces canus* and *Bacillus* sp. TH2 and TH3 (Mori et al., Appl. Environ. Microbiol., 62 (6): 1903-1907 [1996]). trans-P3H has been identified in *Glarea lozoyensis* (Petersen et al., Appl Microbiol Biotechnol. 62(2-3):263-7 [2003]). Cis-P4H enzymes have been identified in *Lotus corniculatus rhizobia, Mesorhibozium loti, Sinorhizobium meliloti,* and *Medicago sativa rhizobia,* (Hara and Kino, Biochem. Biophys. Res. Commun., 379(4):882-6 [2009]; US Pat. Appln. Publ. No. 2011/0091942). Trans-P4H have been identified in *Dactylosporangium* sp., *Amycolatopsis* sp., *Streptomyces griseoviridus, Streptomyces* sp. and *Glarea lozoyensis* (Shibasaki et al., Appl. Environ. Microbiol., 65(9):4028-31 [1999]; Petersen et al., Appl. Microbiol. Biotechnol., 62(2-3):263-7 [2003]; Mori et al., Appl. Environ. Microbiol., 62:1903-1907 [1996]; Lawrence et al., Biochem. J., 313:185-191 [1996]; and EP 0641862).

The cis-4-proline hydroxylase from *Sinorhizobium meliloti* converts free proline to the primary product cis-4-hydroxyproline. According to Klein et al., supra, the enzyme also recognizes L-pipecolic acid, converting it to a mixture of cis-5- and cis-3-hydroxypipecolic acid. However, the activity on pipecolic acid is lower than on proline, and the enzyme is reported to have low specific activity and denature under reaction conditions (Klein et al., supra). Consequently, in vitro conversion reactions for preparing hydroxyproline and hydroxypipecolic acid with a recombinant wild-type enzyme expressed in *E. coli* was unsuitable as a synthetic strategy for commercial scale preparations. Whole cells expressing the enzyme was found to be more effective, but necessitated the use of defined growth medium lacking proline to minimize competition by free proline and also simplify purification of the hydroxypipecolic acid product (Klein et al., supra).

Engineered proline hydroxylases that overcome the deficiencies of the wild-type cis-4-proline hydroxylase of *Sinorhizobium meliloti* are described herein. The engineered proline hydroxylase polypeptides derived from the wild-type enzyme of *Sinorhizobium meliloti* are capable of efficiently converting in vitro free proline to cis-4-hydroxyproline, but also capable of efficiently converting a range of substrates, including the conversion of (S)-pipecolic acid (1) into (2S,5S)-5-hydroxypipecolic acid (2). The present invention identifies amino acid residue positions and corresponding mutations in the proline hydroxylase polypeptide sequence that improve enzyme properties as compared to the naturally occurring enzyme, including among others, activity, stability, expression, regioselectivity, stereoselectivity, substrate tolerance, and substrate specificity. In particular, the present invention provides engineered polypeptides capable of efficiently converting substrate compound (1), to product compound (2), (as illustrated in Scheme 1, above) in presence of a co-substrate (e.g., alpha-ketoglutarate) under suitable reaction conditions (e.g., in the presence of oxygen and Fe(II)).

In some embodiments, the engineered proline hydroxylase polypeptides show increased activity in the hydroxylation of (S)-pipecolic acid (1) into (2S,3S)-hydroxypipecolic acid (2), in a defined time with the same amount of enzyme as compared to the wild-type enzyme. In some embodiments, the engineered proline hydroxylase polypeptide has at least about 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity under suitable reaction conditions as compared to the polypeptide represented by SEQ ID NOS:4, 604, and/or 810.

In some embodiments, the engineered proline hydroxylase polypeptides have increased regioselectivity as compared to the wild-type proline hydroxylase. Specifically, the naturally occurring enzyme converts substrate (1) into the corresponding 5-hydroxylated product (2). As described herein, the enzyme regioselectivity is the ability of the engineered polypeptide to catalyze the hydroxylation reaction at the desired (5S) position over all other possible hydroxylation sites on the substrate.

In some embodiments, the engineered proline hydroxylase polypeptides are capable of converting substrate compound (1) to product compound (2) under suitable reaction conditions with increased tolerance for the presence of substrate relative to the reference polypeptide of SEQ ID NO:4, 604, and/or 810. Thus, in some embodiments the engineered proline hydroxylase polypeptides are capable of converting substrate compound (1) to product compound (2) at a substrate loading concentration of at least about 10 g/L, about 20 g/L, about 30 g/L, about 40 g/L, about 50 g/L, about 70 g/L, about 100 g/L, about 125 g/L, about 150 g/L, about 175 g/L or about 200 g/L or more with a percent conversion of at least about 40%, at least about 50%, at least about 60%, at least about 70%, at least about 80%, at least about 90%, at least about 95%, at least about 98%, or at least about 99%, in a reaction time of about 120 h or less, 72 h or less, about 48 h or less, about 36 h or less, or about 24 h less, under suitable reaction conditions.

The suitable reaction conditions under which the above-described improved properties of the engineered polypeptides carry out the hydroxylation reaction can be determined with respect to concentrations or amounts of polypeptide, substrate, co-substrate, transition metal cofactor, reductant, buffer, co-solvent, pH, conditions including temperature and reaction time, and/or conditions with the polypeptide immobilized on a solid support, as further described below and in the Examples.

In some embodiments, exemplary engineered polypeptides having proline hydroxylase activity with improved properties, particularly in the conversion of compound (1) to compound (2), comprises an amino acid sequence that has one or more residue differences as compared to SEQ ID NO:4 at the residue positions indicated in Tables 4.1, 4.2, 4.3, 4.4, 5.1, 6.1, 6.2, and 6.3.

In some additional embodiments, exemplary engineered polypeptides having proline hydroxylase activity with improved properties, particularly in the conversion of compound (1) to compound (2), comprise an amino acid sequence that has one or more residue differences as compared to SEQ ID NO:604 at the residue positions indicated in Tables 4.5, 4.6, and 4.7.

In some further embodiments, exemplary engineered polypeptides having proline hydroxylase activity with improved properties, particularly in the conversion of compound (1) to compound (2), comprise an amino acid sequence that has one or more residue differences as compared to SEQ ID NO:810 at the residue positions indicated in Table 4.8.

The structure and function information for exemplary non-naturally occurring (or engineered) proline hydroxylase polypeptides of the present invention are based on the conversion of compound (1) to compound (2), the results of which are shown below in Tables 4.1, 4.2, 4.3, 4.4, 4.5, 4.6, 4.7, 4.8, 5.1, 6.1, 6.2, and/or 6.3. The odd numbered sequence identifiers (i.e., SEQ ID NOs) refer to the nucleotide sequence encoding the amino acid sequence provided by the even numbered SEQ ID NOs. The exemplary sequences are provided in the electronic sequence listing file accompanying this invention, which is hereby incorporated by reference herein. The amino acid residue differences are based on comparison to the reference sequence of SEQ ID NOS:4, 604, or 810. The naturally occurring amino acid sequence of the cis-4-proline hydroxylase of *Sinorhizobium meliloti* is provided as SEQ ID NO:2 herein (the corresponding polynucleotide sequence is SEQ ID NO:1, as provided herein). The activity of each engineered polypeptide relative to the reference polypeptide of SEQ ID NO:4, 604 or 810 was determined as conversion of the substrates described in the Examples herein. In some embodiments, a shake flask powder (SFP) or downstream processed (DSP) powder assay is used as a secondary screen to assess the properties of the engineered proline hydroxylases, the results of which are provided in Tables 4.1, 4.2, 4.3, 4.4, 4.5, 4.6, 4.7, 4.8, 5.1, 6.1, 6.2, and/or 6.3. The SFP forms provide a more purified powder preparation of the engineered polypeptides and can contain the engineered polypeptides that are up to about 30% of total protein. The DSP preparations can provide an even further purified form of the engineered polypeptide since the preparations can contain the engineered proline hydroxylases that are up to about 80% of total protein.

In some embodiments, the proline hydroxylase variants of the present invention are tested under HTP assay conditions set forth herein as "Condition A." These variants include those having the following substitutions or substitution sets (with the substitutions listed relative to SEQ ID NO:4): C37I, K39R, A101G, N131H, A156V, F176V, S2E/M151R/F176V, S2F/M151R/F176V, S2H/M151R/F176V, S2I/M151R/F176V, S2N/M151R/F176V, K8Q/S87F/M151R/F176V, K10N/M151R/F176V, R15C/I56R/L76V/G128H/M151R/F176V, R15C/L76V/G128H/M151R/F176V, R15C/M151R/F176V, R15C/I56R/L76V/K136R/M151R/F176V, R15C/I56R/L76V/M151R/F176V, S30R/V44P/A62F/L76V/G128Y/M151R/F176V, S30R/A62C/L76V/G128A/I145C/M151R/F176V, S30R/A62C/L76V/G128A/M151T/F176V, S30R/A62C/L76V/M151R/F176V, S30R/A62F/K71C/L76V/G128A/M151T/F176V, S30R/K71V/G128Y/M151T/F176V, S30R/K71V/L76V/M151R/S160E/F176V, S30R/L76V/G128A/I145C/M151R/F176V, S30R/L76V/G128A/I145C/M151R/F176V/G270V/Y280F, S30R/L76V/G128A/M151R/S160E/F176V, S30R/L76V/G128A/M151R/F176V, S30R/L76V/G128Y/M151R/F176V, S30R/L76V/M151R/F176V, S30T/V44P/V57I/L76V/G128A/M151R/F176V, S30T/V44P/V57I/L76V/G128Y/M151R/F176V, S30T/V44P/A62C/L76V/G128A/M151R/F176V, S30T/A62C/K71V/L76V/G128A/M151T/F176V, S30T/A62C/L76V/G128Y/I145C/M151R/F176V, S30T/A62C/L76V/I145C/M151R/F176V, S30T/A62F/L76V/G128A/I145C/M151R/F176V, S30T/A62F/L76V/G128Y/I145C/M151R/F176V, S30T/K71V/L76V/G128A/M151R/F176V, S30T/K71V/L76V/G128A/M151T/F176V, S30T/L76V/G128A/I145C/M151R/F176V, S30T/L76V/G128A/M151R/S160E/F176V, S30T/L76V/G128Y/I145C/M151R/F176V, S30T/L76V/G128Y/M151R/F176V, S30T/L76V/I145C/M151R/F176V, S30T/L76V/M151R/S160E/F176V, S30T/L76V/M151R/F176V, A36T/V97I, C37L/L42S/D124C/A130F/Q166M/F176V, C37L/D124N/T132S/Q166M/F176V, C37L/A130F/T132S/Q166M/F176V, C37L/A130F/Q166M/F176V, C37L/T132S/Q166M/F176V, C37L/Q166M/F176V, C37L/F176V, C43A/L45C/V58M/K71I/L76V/G128E/M151R/L165Y/F176V, C43A/K71I/L76V/G128E/M151R/F176V, C43A/E114H/M151H/L165Y/F176V, C43A/E114K/G128T/M151G/L165F/F176V/D237A, C43A/E114K/G128T/M151G/F176V/D237T/G270R, C43A/E114K/M151G/L165Y/A173R/F176V/D237K/E273V, C43A/E114K/M151G/A173R/F176V/D237S/G270R, C43A/E114K/M151G/F176V, C43A/E114K/M151Q/F176V/D237K/G270R, C43A/E114K/M151Q/L165Y/F176V/D237A/E273V, C43A/E114R/E115P/M151R/F176V/E273V, C43A/E115P/G128T/M151G/F176V/E273V, C43A/E115P/M151G/L165Y/A173R/F176V/D237C, C43A/E115P/L121M/M151Q/L165Y/F176V/E273V, C43A/E115P/G128T/M151G/A173R/F176V/E273V, C43A/G128A/M151G/L165Y/F176V/E273V, C43A/G128A/M151G/A173R/F176V/D237S/G270R, C43A/G128A/M151Q/A173R/F176V/D237S/E273V, C43A/G128T/M151G/L165Y/A173R/F176V/D237C/G270R, C43A/G128T/M151G/L165Y/F176V/E273V, C43A/G128T/M151R/L165Y/F176V/E273V, C43A/G128T/M151G/A173R/F176V/D237T/G270R, C43A/G128T/M151G/F176V/D237A, C43A/G128T/M151Q/F176V/D237S/G270R, C43A/G128T/M151R/F176V/D237C/E273V, C43A/M151G/L165Y/F176V/E273V, C43A/M151G/A173R/F176V/G270R/E273V, C43A/M151G/F176V/G270R/E273V, C43A/M151Q/L165Y/F176V/D237C/E273V, C43A/M151Q/A173R/F176V/D237C/G270R, C43A/M151Q/A173R/F176V/D237S/G270R/E273V, C43A/M151Q/F176V/D237C, C43A/M151Q/F176V/G270R, C43A/M151Q/F176V/D237A/E273V, C43A/M151R/L165Y/F176V/D237K, C43A/M151R/L165Y/F176V/D237K/G270R, C43A/M151R/L165Y/F176V/E273V, C43A/M151R/F176V/D237A/E273V, C43A/M151R/F176V/E273V, C43A/F176V, V44M/F176V, L45C/V58M/L76V/G128E/M151R/L165Y/F176V, L45C/V58M/L76V/M151R/L165Y/F176V, L45C/L76V/M151R/L165Y/F176V, R48I/L76V/G128T/M151N/F176V, R48I/L76V/M151R/F176V, G50A/L76V/M151R/F176V, G50A/M151R/F176V, G50S/M151R/F176V, I56R/M151R/F176V, V57I/A62C/L76V/G128Y/M151T/F176V, V57I/L76V/M151R/F176V, V57I/M151R/F176V, V58M/K71I/L76V/V92C/M151R/L165Y/F176V, V58M/K71I/L76V/M151R/L165Y/F176V, V58M/L76V/L119A/M151R/F176V, V58M/L76V/M151R/F176V, V58M/M151R/F176V, A62C/L76V/I145C/M151R/F176V, A62C/M151R/F176V, A62F/M151R/F176V, P63F/L76V/M151N/F176V, P63F/L76V/M151R/F176V, P63F/M151R/F176V, P63H/L76V/G128H/K136R/M151R/F176V, P63H/M151R/F176V, P63I/L76V/

K136R/M151R/F176V, P63I/L76V/G128H/K136R/ M151R/F176V, P63I/L76V/M151R/F176V, P63I/M151R/ F176V, P63L/L76V/M151N/F176V, P63L/L76V/M151R/ F176V, P63L/M151R/F176V, P63V/L76V/M151R/F176V, P63V/M151R/F176V, K71C/L76V/G128A/M151R/S160E/ F176V, K71C/L76V/G128Y/M151T/F176V, K71C/M151R/ F176V, K71I/L76V/V92C/G128E/M151R/L165Y/F176V, K71I/L76V/G128E/M151R/F176V, K71I/M151R/F176V, K71V/M151R/F176V, K71V/L76V/G128Y/M151T/F176V, L76F/M151R/F176V, L76V/S87C/M151N/F176V, L76V/ S87W/G128H/K136R/M151R/F176V, L76V/R88W/ G128A/M151R/F176V, L76V/R88W/G128Y/M151R/ F176V, L76V/L119A/D124H/M151R/L165Y/F176V, L76V/L119A/M151R/L165Y/F176V, L76V/G128A/I145C/ M151R/F176V, L76V/G128A/M151R/F176V, L76V/ G128A/M151R/S160E/F176V, L76V/G128E/M151R/ F176V, L76V/G128H/E134Q/K136R/M151R/F176V, L76V/G128H/M151R/F176V, L76V/G128T/M151N/ F176V, L76V/G128T/M151R/F176V, L76V/G128Y/I145C/ M151R/F176V, L76V/G128Y/I145C/M151T/F176V, L76V/G128Y/M151R/S160E/F176V, L76V/G128Y/ M151R/F176V, L76V/G128Y/M151T/F176V, L76V/ M151R/S160R/F176V, L76V/M151R/F176V, N77Y/ M151R/F176V, E81C/M151R/F176V, E81L/M151R/ F176V, S87C/M151R/F176V, S87F/M151R/F176V, S87L/ M151R/F176V, S87P/M151R/F176V, S87V/M151R/ F176V, S87W/M151R/F176V, S87Y/M151R/F176V, R88V/ F176V, E114R/M151Q/F176V/G270R/E273V, E114K/ F176V, E114R/F176V, E115P/F176V, E115Q/G128T/ M151R/A173R/F176V, G128T/M151R/L165Y/F176V/ D237K/G270R, G128T/F176V, M151G/L165Y/F176V/ E273V, M151Q/A173R/F176V/D237S/G270R/E273V, M151G/A173R/F176V/G270R/E273V, M151G/F176V, M151K/F176V, M151N/F176V, M151Q/F176V, M151R/ F176V, M151T/F176V, I56R/P63H/L76V/K136R/M151R/ F176V, I56R/L76V/K136R/M151R/F176V, I56R/L76V/ M151R/F176V, L165Y/F176V, A173R/F176V, F176V/ V194I, F176V/D237A, F176V/D237C, F176V/D237K, F176V/D237S, F176V/D237T, F176V/G270K, F176V/ G270R, F176V/R274P, F176V/E273V, F176V/R274A, F176V/R274E, F176V/R274L, and F176V/R274Q.

In some embodiments, the proline hydroxylase variants of the present invention are tested under HTP assay conditions set forth herein as "Condition B." These variants include those having the following substitutions or substitution sets (with the substitutions listed relative to SEQ ID NO:4): S30R/C37I/K39R/A62C/L76V/M151R/S160R/F176V/ S240H/A256D, S30R/C37I/L76V/A101G/M151T/P153G/ L165Y/F176V/S240H/L269I, S30R/C37I/L76V/M151R/ S160R/F176V, S30R/L76V/A101G/M151T/S160R/L165Y/ F176V/S240H, S30R/L76V/M151R/S160R/L165Y/F176V, S30R/L76V/M151R/S160R/L165Y/F176V/S240H/A256D, S30R/L76V/M151T/S160R/F176V, S30T/I56R/L76V/ K136R/M151R/S160R/F176V, S30T/I56R/L76V/M151N/ S160R/F176V, S30T/I56R/L76V/M151R/S160R/F176V, S30T/L76V/M151R/S160R/F176V, C37I/K39R/A62C/ L76V/A101G/M151R/S160R/F176V, C37I/K39R/L76V/ M151R/S160R/F176V, C43A/V58M/L76V/M151R/S160R/ F176V/F180Y/V184F, C43A/V58M/L76V/M151R/S160R/ F176V/I213E/R266Q/R274Y, C43A/L76V/M151R/S160R/ F176V/E178C/F180Y/V184F/I213E/S263D, L76V/S87C/ G128T/K136R/M151N/L165Y/F176V, L76V/K136N/ M151R/S160R/F176V/R274P/G275A, L76V/K136R/ M151R/S160R/F176V, L76V/M151R/S160R/F176V/ S263E/R274Y, L76V/M151R/S160R/F176V/R274P, L76V/ M151R/S160R/F176V/R274P/Y280L, and L76V/M151T/ S160R/L165Y/F176V/S240H.

In some embodiments, the proline hydroxylase variants of the present invention are tested under HTP assay conditions set forth herein as "Condition C." These variants include those having the following substitutions or substitution sets (with the substitutions listed relative to SEQ ID NO:4): H4P/S30R/C37I/N61D/A62G/L76V/V97A/M151R/S160R/ F176V/H271Q, S30A/C37I/L76V/M151R/S160R/F176V, S30E/C37I/L76V/M151R/S160R/F176V, S30G/C37I/ L76V/M151R/S160R/F176V, S30N/C37I/L76V/M151R/ S160R/F176V, S30R/S33T/C37I/N61D/A62G/L76V/ V97A/A130L/M151R/S160R/F176V/H271Q, S30R/S33T/ C37I/A62G/L76V/V97A/L119V/M151R/S160R/F176V/ H271Q, S30R/S33T/C37I/L76V/V97A/L119V/M151R/ S160R/F176V, S30R/S33T/C37I/L76V/M151R/S160R/ F176V, S30R/C37I/K39P/L76V/M151R/S160R/F176V, S30R/C37I/K39T/L76V/M151R/S160R/F176V, S30R/ C37I/Q52P/L76V/M151R/S160R/F176V, S30R/C37I/ D55E/L76V/M151R/S160R/F176V, S30R/C37I/V58T/ L76V/M151R/S160R/F176V, S30R/C37I/N61D/A62E/ L76V/V97A/L119V/M151R/S160R/F176V, S30R/C37I/ N61D/L76V/V97A/M151R/S160R/F176V, S30R/C37I/ N61D/L76V/V97A/M151R/S160R/F176V/H271Q, S30R/ C37I/N61D/L76V/M151R/S160R/F176V, S30R/C37I/ N61D/A62E/L76V/V97A/M151R/S160R/F176V/H271Q, S30R/C37I/N61D/A62G/L76V/V97A/S98P/M151R/ S160R/F176V/H271Q, S30R/C37I/N61D/A62G/L76V/ V97A/M151R/S160R/F176V, S30R/C37I/N61D/A62T/ L76V/V97A/L119V/M151R/S160R/F176V/H271Q, S30R/ C37I/N61D/A62T/L76V/V97A/M151R/S160R/F176V/ H271Q, S30R/C37I/A62E/L76V/I94L/V97A/L119V/ M151R/S160R/F176V, S30R/C37I/A62E/L76V/V97A/ M151R/S160R/F176V, S30R/C37I/A62E/L76V/V97A/ M151R/S160R/F176V/H271Q, S30R/C37I/A62E/L76V/ M151R/S160R/F176V, S30R/C37I/A62G/L76V/V97A/ S98P/M151R/S160R/F176V, S30R/C37I/A62G/L76V/ V97A/M151R/S160R/F176V, S30R/C37I/A62G/L76V/ V97A/M151R/S160R/F176V/H271Q, S30R/C37I/A62G/ L76V/M151R/S160R/F176V, S30R/C37I/A62R/L76V/ V97A/D124E/M151R/S160R/F176V, S30R/C37I/A62R/ L76V/V97A/M151R/S160R/F176V, S30R/C37I/A62R/ L76V/V97A/M151R/S160R/F176V/H271Q, S30R/C37I/ A62R/L76V/M151R/S160R/F176V, S30R/C37I/A62T/ L76V/V97A/S98P/M151R/S160R/F176V, S30R/C37I/ A62T/L76V/V97A/L119V/M151R/S160R/F176V/H271Q, S30R/C37I/A62T/L76V/V97A/M151R/S160R/F176V/ H271Q, S30R/C37I/A62T/L76V/M151R/S160R/F176V, S30R/C37I/L76V/I94L/M151R/S160R/F176V, S30T/C37I/ L76V/V95I/V97A/M151R/S160R/F176V, S30R/C37I/ L76V/V95I/M151R/S160R/F176V, S30R/C37I/L76V/ V97A/S98P/M151R/S160R/F176V, S30R/C37I/L76V/ V97A/L119V/M151R/S160R/F176V/H271Q, S30R/C37I/ L76V/V97A/M151R/S160R/F176V, S30R/C37I/L76V/ V97A/M151R/S160R/F176V/H271Q, S30R/C37I/L76V/ S98P/M151R/S160R/F176V, S30R/C37I/L76V/S107A/ M151R/S160R/F176V, S30R/C37I/L76V/S107M/M151R/ S160R/F176V, S30R/C37I/L76V/Y109F/M151R/S160R/ F176V, S30R/C37I/L76V/E114G/M151R/S160R/F176V, S30R/C37I/L76V/E114N/M151R/S160R/F176V, S30R/ C37I/L76V/E114Q/M151R/S160R/F176V, S30R/C37I/ L76V/E114S/M151R/S160R/F176V, S30R/C37I/L76V/ E115G/M151R/S160R/F176V, S30R/C37I/L76V/L119V/ M151R/S160R/F176V, S30R/C37I/L76V/A130L/M151R/ S160R/F176V, S30R/C37I/L76V/M151R/S160C/F176V, S30R/C37I/L76V/M151G/S160R/F176V, S30R/C37I/ L76V/M151G/S160R/F176V, S30R/C37L/L76V/M151R/ S160R/F176V, S30R/C37I/L76V/M151R/S160R/F176V/ H271Q, S30R/C37I/L76V/M151R/S160R/F176V/V277E, S30R/C37I/L76V/M151R/S160R/F176V/V277M, S30R/C37I/L76V/M151R/S160R/F176V/V277K, S30R/C37I/L76V/M151R/S160R/F176V/V277R, S30R/C37I/V97A/M151R/S160R/F176V, S30R/C37I/V97A/M151R/S160R/F176V/V277M, S30T/C37I/L76V/M151R/S160R/F176V, and S30V/C37I/L76V/M151R/S160R/F176V.

In some embodiments, the proline hydroxylase variants of the present invention are tested under HTP assay conditions set forth herein as "Condition D." These variants include those having the following substitutions or substitution sets (with the substitutions listed relative to SEQ ID NO:4): S30R/C37I/D55E/L76V/M151R/S160R/F176V, S30R/C37I/D55S/L76V/M151R/S160R/F176V, S30R/C37I/V57A/L76V/M151R/S160R/F176V, S30R/C37I/V57A/V97A/M151R/S160R/F176V, S30R/C37I/V57L/L76V/M151R/S160R/F176V, S30R/C37I/V57T/L76V/M151R/S160R/F176V, S30R/C37I/V58C/L76V/M151R/S160R/F176V, S30R/C37I/V58H/L76V/M151R/S160R/F176V, S30R/C37I/V58L/L76V/M151R/S160R/F176V, S30R/C37I/V58N/L76V/M151R/S160R/F176V, S30R/C37I/V58T/L76V/M151R/S160R/F176V, S30R/C37I/V58Y/L76V/M151R/S160R/F176V, S30R/C37I/L76V/S107A/M151R/S160R/F176V, S30R/C37I/L76V/S107M/M151R/S160R/F176V, S30R/C37I/L76V/Y109F/M151R/S160R/F176V, S30R/C37I/L76V/E115C/M151R/S160R/F176V, S30R/C37I/L76V/E115G/M151R/S160R/F176V, S30R/C37I/L76V/M151G/S160R/F176V, S30R/C37I/L76V/M151R/A156S/S160R/F176V, S30R/C37I/L76V/M151R/S160C/F176V, S30R/C37I/L76V/M151R/S160R/Q166L/F176V, S30R/C37I/L76V/M151R/S160R/Q166V/F176V, S30R/C37I/L76V/M151R/S160R/M168I/F176V, S30R/C37I/L76V/M151R/S160R/M168L/F176V, S30R/C37I/L76V/M151R/S160R/M168R/F176V, S30R/C37I/L76V/M151R/S160R/F176V/V277E, S30R/C37I/L76V/M151R/S160R/F176V/V277K, S30R/C37I/L76V/M151R/S160R/F176V/V277M, S30R/C37I/L76V/M151R/S160R/F176V/V277R, and L76V/M151R/S160R/F176V/S30R/C37I/V58S.

In some embodiments, the proline hydroxylase variants of the present invention are tested under HTP assay conditions set forth herein as "Condition E." These variants include those having the following substitutions or substitution sets (with the substitutions listed relative to SEQ ID NO:604): R30N/A57V/A62E/L76V/A97V/E114S/H271R/E273T, R30N/N61D/A62E/E114K/H271W/E273G, R30N/N61D/A62D/E114S/H271W, R30N/N61D/A62E/E114N/H271W, R30N/N61D/A62E/E114N/H271W/E273T, R30N/N61D/A62E/E114S/H271W/E273T, R30N/A62D/E114N/H271W/E273T, R30N/A62D/E114S/H271W/E273T, R30N/A62D/H271R, R30N/A62E/E114N/H271W, R30N/A62E/E114S/H271W/E273T, R30N/A62E/E114S/E273G, and A62D/E114S/H271W.

In some embodiments, the proline hydroxylase variants of the present invention are tested under HTP assay conditions set forth herein as "Condition F." These variants include those having the following substitutions or substitution sets (with the substitutions listed relative to SEQ ID NO:604): S24T/R30N/A62D/E114S/H271W/E273T, R26G/R30N/A62D/E114S/H271W/E273T, R30N/A62D/S72V/E114S/H271W/E273T, R30N/A62D/T82K/E114S/H271W/E273T, R30N/A62D/T82R/E114S/H271W/E273T, R30N/A62D/E114S/S127R/H271W/E273T, R30N/A62D/E114S/S127T/H271W/E273T, R30N/A62D/E114S/L142Q/H271W/E273T, R30N/A62D/E114S/A173Y/H271W/E273T, R30N/A62D/E114S/A175Q/H271W/E273T, R30N/A62D/E114S/F180M/H271W/E273T, R30N/A62D/E114S/Q186R/H271W/E273T, R30N/A62D/E114S/P187C/H271W/E273T, R30N/A62D/E114S/V188I/H271W/E273T, R30N/A62D/E114S/T189H/H271W/E273T, R30N/A62D/E114S/T189I/H271W/E273T, R30N/A62D/E114S/R191L/H271W/E273T, R30N/A62D/E114S/D192Q/H271W/E273T, R30N/A62D/E114S/G207C/H271W/E273T, R30N/A62D/E114S/G207M/H271W/E273T, R30N/A62D/E114S/G207W/H271W/E273T, R30N/A62D/E114S/G210M/H271W/E273T, R30N/A62D/E114S/S240Q/H271W/E273T, R30N/A62D/E114S/S240T/H271W/E273T, R30N/A62D/E114S/S263D/H271W/E273T, and R30N/A62D/E114S/H271W/E273T.

In some embodiments, the proline hydroxylase variants of the present invention are tested under HTP assay conditions set forth herein as "Condition G." These variants include those having the following substitutions or substitution sets (with the substitutions listed relative to SEQ ID NO:604): E13K/E27T/R30N/A62D/T82R/C86E/E114S/G207W/A256R/S263D/H271W/E273T, E13K/R30N/A62D/E114S/L142S/A175Q/F180M/S263D/H271W/E273T, A14G/R30N/A62D/E114S/H271W/E273T, S24T/R26A/R30N/A62D/S72E/T82K/E114S/G128A/A173Y/V176D/I213L/S240T/H271W/E273T, S24T/R26A/R30N/A62D/S72E/T82K/E114S/G128A/F233Y/H271W/E273T, S24T/R26A/R30N/A62D/S72E/E114S/C158N/K161P/T189A/H271W/E273T, S24T/R26A/R30N/A62D/S72E/E114S/K161P/A173K/S240T/H271W/E273T, S24T/R26A/R30N/A62D/S72E/E114S/K161P/F233E/H271W/E273T, S24T/R26A/R30N/A62D/S72Y/E114S/G128A/T189A/S240C/H271W/E273T, S24T/R26A/R30N/A62D/T82K/E114S/G128A/K161P/A173Y/F180M/K198A/I213L/F233E/S40T/H271W/E273T, S24T/R26A/R30N/A62D/T82K/E114S/C158N/K161P/F180M/F233E/H271W/E273T, S24T/R26A/R30N/A62D/E114S/G128A/A173K/T189A/S225A/F233E/H271W/E273T, S24T/R26A/R30N/A62D/E114S/G128A/F180M/G207K/H271W/E273 T, S24T/R26A/R30N/A62D/E114S/A173Y/H271W/E273T, S24T/R26A/R30N/A62D/E114S/C158N/T189A/D192A/S225A/H271W/E273T, S24T/R26A/R30N/A62D/E114S/T189A/H271W/E273T, S24T/R26G/R30N/A62D/S72E/T82K/E114S/G128A/C158N/K161P/T189A/S240T/M241C/H271W/E273T, S24T/R26G/R30N/A62D/S72E/E114S/C158N/A173K/I213L/F233Y/H271W/E273T, S24T/R30N/A62D/E114S/C158N/K161P/V176D/F233E/H271W/E273T, S24T/R30N/A62D/E114S/A173K/H271W/E273T, S24T/R30N/A62D/E114S/T189H/D192W/H271W/E273T, R26A/R30N/A62D/S72E/T82K/E114S/A173Y/D192A/S240T/H271W/E273T, R26A/R30N/A62D/S72E/E114S/G128A/C158N/K198A/H271W/E273T, R26A/R30N/A62D/S72E/E114S/C158N/K161P/D192P/H271W/E273T, R26A/R30N/A62D/S72E/E114S/C158N/D192P/S240T/M241C/H271W/E273T, R26A/R30N/A62D/S72E/E114S/K161P/S225A/H271W/E273T, R26A/R30N/A62D/S72E/E114S/K161P/H271W/E273T, R26A/R30N/A62D/S72E/E114S/A173Y/F180M/H271W/E273T, R26A/R30N/A62D/T82K/E114S/C158N/K161P/H271W/E273T, R26A/R30N/A62D/T82K/E114S/F233Y/H271W/E273T, R26A/R30N/A62D/E114S/K161P/T189A/D192P/F233E/S240T/H271W/E273T, R26A/R30N/A62D/E114S/A173Y/V176D/F180M/T189A/D192P/S225A/M241C/H271W/E273T, R26G/R30N/A62D/S72E/E114S/C158N/A173K/T189A/F233E/H271W/E273T, R26G/R30N/A62D/S72Y/E114S/C158N/H271W/E273T, R26G/R30N/A62D/T82K/E114S/G128A/K161P/F180M/K198A/H271W/E273T, R26G/R30N/A62D/T82K/E114S/K161P/A173Y/F180M/D192A/F233E/H271W/E273T, R26G/R30N/A62D/T82K/E114S/H271W/E273T, E27T/R30N/A62D/T82R/E114S/G128F/D192Q/A256R/H271W/E273T, E27T/R30N/A62D/T82R/

E114S/L142S/D192Q/S263D/H271W/E273T, E27T/R30N/ A62D/T82R/E114S/A175Q/D192Q/H271W/E273T, E27T/ R30N/A62D/T82R/E114S/F180M/D192Q/H271W/E273T, E27T/R30N/A62D/E114S/G207W/A236S/S263D/H271W/ E273T, E27T/R30N/A62D/E114S/G207W/S240R/S263D/ H271W/E273T, E27T/R30N/A62D/E114S/A256R/H271W/ E273T, E27T/R30N/A62D/E114S/S263D/H271W/E273T, R30N/A62D/S72E/T82K/E114S/A173K/F180M/G207R/ I213L/S225A/F233E/H271W/E273T, R30N/A62D/S72E/ T82K/E114S/I213L/F233E/H271W/E273T, R30N/A62D/ S72E/E114S/C158N/H271W/E273T, R30N/A62D/S72E/ E114S/A173Y/T189A/F233E/H271W/E273T, R30N/ A62D/S72V/E114S/Q186G/M193I/H271W/E273T, R30N/ A62D/S72V/E114S/S240Q/H271W/E273T, R30N/A62D/ N77L/E114S/H271W/E273T, R30N/A62D/E81V/E114S/ H271W/E273T, R30N/A62D/T82K/E114S/G128A/I213L/ H271W/E273T, R30N/A62D/T82R/C86E/E114S/R191L/ D192Q/S263D/H271W/E273T, R30N/A62D/T82R/E114S/ G128F/S263D/H271W/E273T, R30N/A62D/T82R/E114S/ G128N/H271W/E273T, R30N/A62D/T82R/E114S/L142S/ A175Q/F180M/G207W/A256R/H271W/E273T, R30N/ A62D/T82R/E114S/A175Q/F180M/C238T/S240R/S263D/ H271W/E273T, R30N/A62D/T82R/E114S/G207W/ A256R/S263D/H271W/E273T, R30N/A62D/T82R/E114S/ G207W/S263D/H271W/E273T, R30N/A62D/C86E/E114S/ G207W/S263D/H271W/E273T, R30N/A62D/R88H/ E114S/H271W/E273T, R30N/A62D/E114S/S127R/K161G/ E185V/H271W/E273T, R30N/A62D/E114S/S127R/ K161G/V188I/T189P/H271W/E273T, R30N/A62D/E114S/ S127T/S240Q/H271W/E273T, R30N/A62D/E114S/G128F/ L142Q/R191L/D192Q/S263D/H271W/E273T, R30N/ A62D/E114S/G128K/L142S/A256R/S263D/H271W/ E273T, R30N/A62D/E114S/G128S/H271W/E273T, R30N/ A62D/E114S/L142G/H271W/E273T, R30N/A62D/E114S/ L142Q/S263D/H271W/E273T, R30N/A62D/E114S/ C158N/A173Y/I213L/H271W/E273T, R30N/A62D/E114S/ C158N/H271W/E273T, R30N/A62D/E114S/K161G/ E185V/V188I/T189H/H271W/E273T, R30N/A62D/E114S/ K161G/E185V/T189H/H271W/E273T, R30N/A62D/ E114S/K161G/T189H/H271W/E273T, R30N/A62D/ E114S/P163E/H271W/E273T, R30N/A62D/E114S/A173Y/ F180M/H271W/E273T, R30N/A62D/E114S/A173Y/ S263G/H271W/E273T, R30N/A62D/E114S/A173Y/ H271W/E273T, R30N/A62D/E114S/V176K/P187H/ S263G/H271W/E273T, R30N/A62D/E114S/V176K/ P187H/H271W/E273T, R30N/A62D/E114S/E178R/ V184L/Q186G/H271W/E273T, R30N/A62D/E114S/ V184L/Q186G/T189I/G207R/H271W/E273T, R30N/ A62D/E114S/V184L/Q186G/T189I/S240Q/H271W/ E273T, R30N/A62D/E114S/V184L/Q186R/G207M/ H271W/E273T, R30N/A62D/E114S/V184L/T189I/G207K/ H271W/E273T, R30N/A62D/E114S/V184L/T189I/ G207M/H271W/E273T, R30N/A62D/E114S/V184L/ G207R/H271W/E273T, R30N/A62D/E114S/V184L/ G210M/S240Q/H271W/E273T, R30N/A62D/E114S/ Q186G/T189I/G207R/H271W/E273T, R30N/A62D/E114S/ Q186G/T189I/S240I/H271W/E273T, R30N/A62D/E114S/ Q186R/T189I/G207R/H271W/E273T, R30N/A62D/E114S/ Q186R/T189I/S240I/H271W/E273T, R30N/A62D/E114S/ Q186R/T189I/H271W/E273T, R30N/A62D/E114S/Q186R/ G207M/H271W/E273T, R30N/A62D/E114S/Q186R/ G207R/H271W/E273T, R30N/A62D/E114S/Q186R/ H271W/E273T, R30N/A62D/E114S/P187H/S263G/ H271W/E273T, R30N/A62D/E114S/P187H/H271W/ E273T, R30N/A62D/E114S/T189A/E273A, R30N/A62D/ E114S/T189I/S240I/H271W/E273T, R30N/A62D/E114S/ T189V/H271W/E273T, R30N/A62D/E114S/R191L/ D192Q/G207W/S263D/H271W/E273T, R30N/A62D/ E114S/D192Q/H271W/E273T, R30N/A62D/E114S/ D195A/H271W/E273T, R30N/A62D/E114S/D195G/ H271W/E273T, R30N/A62D/E114S/L200A/H271W/ E273T, R30N/A62D/E114S/G207R/H271W/E273T, R30N/ A62D/E114S/L209E/H271W/E273T, R30N/A62D/E114S/ L209G/H271W/E273T, R30N/A62D/E114S/G210M/ S240Q/H271W/E273T, R30N/A62D/E114S/F211S/ H271W/E273T, R30N/A62D/E114S/I213G/H271W/ E273T, R30N/A62D/E114S/I213L/F233E/H271W/E273T, R30N/A62D/E114S/I213R/H271W/E273T, R30N/A62D/ E114S/I215V/H271W/E273T, R30N/A62D/E114S/E217G/ H271W/E273T, R30N/A62D/E114S/A218C/H271W/ E273T, R30N/A62D/E114S/A218G/H271W/E273T, R30N/ A62D/E114S/E222Q/H271W/E273T, R30N/A62D/E114S/ L230E/H271W/E273T, R30N/A62D/E114S/C238G/ H271W/E273T, R30N/A62D/E114S/C238S/H271W/ E273T, R30N/A62D/E114S/S240I/H271W/E273T, R30N/ A62D/E114S/S240Q/S263G/H271W/E273T, R30N/A62D/ E114S/S240Q/H271W/E273T, R30N/A62D/E114S/M241I/ H271W/E273T, R30N/A62D/E114S/M241V/H271W/ E273T, R30N/A62D/E114S/E259G/H271W/E273T, R30N/ A62D/E114S/S263G/H271W/E273T, R30N/A62D/E114S/ E265C/H271W/E273T, and R30N/A62D/E114S/E265V/ H271W/E273T.

In some embodiments, the proline hydroxylase variants of the present invention are tested under HTP assay conditions set forth herein as "Condition H." These variants include those having the following substitutions (with the substitutions listed relative to SEQ ID NO:810): S33G, S33H, S33K, S33T, S33W, W40Q, W40T, V95I, A156F, A156S, and A156V.

In some embodiments, the proline hydroxylase variants of the present invention are tested under SFP assay conditions set forth herein as "Condition I." These variants include those having the following substitutions or substitution sets (with the substitutions listed relative to SEQ ID NO:4): R26A/S30N/C37I/V57A/A62D/T82K/V97A/E114S/ M151R/C158N/S160R/K161P/F176V/H271W/E273T; S30N/C37I/V57A/A62D/V97A/E114S/M151R/S160R/ F176V/H271W/E273T, S30R/C37I/V57A/V97A/M151R/ S160R/F176V, S30R/C37I/L76V/M151R/S160R/F176V, S30R/C37I/V97A/M151R/S160R/F176V, and M151R/ F176V.

In some embodiments, the proline hydroxylase variants of the present invention are tested under DSP assay conditions set forth herein as "Condition J." These variants include those having the following substitutions or substitution sets (with the substitutions listed relative to SEQ ID NO:4): R26A/S30N/C37I/V57A/A62D/T82K/V97A/E114S/ M151R/C158N/S160R/K161P/F176V/H271W/E273 T; S30N/C37I/V57A/A62D/V97A/E114S/M151R/S160R/ F176V/H271W/E273T; S30R/C37I/V57A/V97A/M151R/ S160R/F176V; S30R/C37I/L76V/M151R/S160R/F176V; S30R/C37I/V97A/M151R/S160R/F176V; and M151R/ F176V.

In some embodiments, the proline hydroxylase variants of the present invention are tested under DSP assay conditions set forth herein as "Condition K." These variants include those having the following substitutions or substitution sets (with the substitutions listed relative to SEQ ID NO:4): R26A/S30N/C37I/V57A/A62D/T82K/V97A/E114S/ M151R/C158N/S160R/K161P/F176V/H271W/E273 T, S30N/C37I/V57A/A62D/V97A/E114S/M151R/S160R/ F176V/H271W/E273T, S30R/C37I/V57A/V97A/M151R/

S160R/F176V, S30R/C37I/L76V/M151R/S160R/F176V, S30R/C37I/V97A/M151R/S160R/F176V, and M151R/F176V.

In some embodiments, the proline hydroxylase variants of the present invention are tested under DSP assay conditions set forth herein as "Condition L." These variants include those having the following substitutions or substitution sets (with the substitutions listed relative to SEQ ID NO:4): R26A/S30N/C37I/V57A/A62D/T82K/V97A/E114S/M151R/C158N/S160R/K161P/F176V/H271W/E273T, S30N/C37I/V57A/A62D/V97A/E114S/M151R/S160R/F176V/H271W/E273T, S30R/C37I/V57A/V97A/M151R/S160R/F176V, S30R/C37I/L76V/M151R/S160R/F176V, S30R/C37I/V97A/M151R/S160R/F176V, and M151R/F176V.

In some embodiments, the specific enzyme properties associated with the residues differences as compared to SEQ ID NO:4, 604, and/or 810 at the residue positions indicated herein include, among others, enzyme activity, regioselectivity, polypeptide expression, and substrate tolerance. Improvements in enzyme activity and substrate tolerance are associated with residue differences at residue positions indicated in the Examples herein. Improvements in regioselectivity are associated with residue differences at residue positions indicated in the Examples herein. In some embodiments, improvements in polypeptide expression are provided herein. Accordingly, the residue differences at these residue positions can be used individually or in various combinations to produce engineered proline hydroxylase polypeptides having the desired improved properties, including, among others, enzyme activity, regioselectivity, stereoselectivity, and substrate tolerance. Other residue differences affecting polypeptide expression can be used to increase expression of the engineered proline hydroxylase.

In light of the guidance provided herein, it is further contemplated that any of the exemplary engineered polypeptides comprising the even-numbered sequences of SEQ ID NOS: 4-1004 find use as the starting amino acid sequence for synthesizing other engineered proline hydroxylase polypeptides, for example by subsequent rounds of evolution that incorporate new combinations of various amino acid differences from other polypeptides in Tables 4.1, 4.2, 4.3, 4.4, 4.5, 4.6, 4.7, 4.8, 5.1, 6.1, 6.2, and/or 6.3, and other residue positions described herein. Further improvements may be generated by including amino acid differences at residue positions that had been maintained as unchanged throughout earlier rounds of evolution.

In some embodiments, the engineered polypeptide having proline hydroxylase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4 and one or more residue differences as compared to SEQ ID NO:4 at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280.

In some embodiments, the engineered polypeptide having proline hydroxylase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:604 and one or more residue differences as compared to SEQ ID NO:604 at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273.

Accordingly, in some embodiments, the engineered polypeptide having proline hydroxylase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:810 and one or more residue differences as compared to SEQ ID NO:810 at residue positions selected from: 33, 40, 95, and 156.

In some embodiments, the engineered polypeptide having proline hydroxylase activity with improved properties as compared to SEQ ID NO:4, 604, and/or 810 comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:4, and one or more residue differences as compared to SEQ ID NO:4 at residue positions selected from 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280. In some embodiments, the engineered polypeptide having proline hydroxylase activity with improved properties as compared to SEQ ID NOS:4, 604, and/or 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:4 and one or more residue differences selected from 2E, 2F, 2H, 2I, 2N, 4P, 8Q, 10N, 15C, 26A, 30A, 30E, 30G, 30N, 30R, 30T, 30V, 33T, 36T, 37I, 37L, 39P, 39R, 39T, 42S, 43A, 44M, 44P, 45C, 48I, 50A, 50S, 52P, 55E, 55S, 56R, 57A, 57I, 57L, 57T, 58C, 58H, 58L, 58M, 58N, 58S, 58T, 58Y, 61D, 62C, 62D, 62E, 62F, 62G, 62R, 62T, 63F, 63H, 63I, 63L, 63V, 71C, 71I, 71V, 76V, 77Y, 81C, 81L, 82K, 87C, 87F, 87L, 87P, 87V, 87W, 87Y, 88V, 88W, 92C, 94L, 95I, 97A, 97I, 98P, 101G, 107A, 107M, 109F, 114G, 114H, 114K, 114N, 114Q, 114R, 114S, 115C, 115G, 115P, 115Q, 119A, 119V, 121M, 124C, 124E, 124H, 124N, 128A, 128E, 128H, 128T, 128Y, 130F, 130L, 131H, 132S, 134Q, 136N, 136R, 145C, 151G, 151H, 151K, 151N, 151Q, 151R, 151T, 153G, 156S, 156V, 158N, 160C, 160E, 160R, 161P, 165F, 165Y, 166L, 166M, 166V, 168I, 168L, 168R, 173R, 176V, 178C, 180Y, 184F, 194I, 213E, 237A, 237C, 237K, 237S, 237T, 240H, 256D, 263D, 263E, 266Q, L269I, 270K, 270R, 270V, 271Q, 271W, 273T, 273V, 274A, 274E, 274L, 274P, 274Q, 274Y, 275A, 277E, 277K, 277M, 277R, 280F, and 280L (relative to SEQ ID NO:4). In some embodiments, the engineered polypeptide having proline hydroxylase activity with improved properties as compared to SEQ ID NOS:4, 604, and 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:4 and one or more residue differences selected from S2E, S2F, S2H, S2I, S2N, H4P, K8Q, K10N, R15C, R26A, S30A S30E, S30G, S30N, S30R, S30T, S30V, S33T, A36T, C37I, C37L, K39P, K39R, K39T, L42S, C43A, V44M, V44P, L45C, R48I, G50A, G50S, Q52P, D55E, D55S, I56R, V57A, V57I, V57L, V57T, V58C, V58H, V58L, V58M, V58N, V58S, V58T, V58Y, N61D, A62C A62D, A62E, A62F, A62G, A62R, A62T, P63F, P63H, P63I, P63L, P63V, K71C, K71I, K71V, L76F, L76V, N77Y, E81C, E81L, T82K, S87C, S87F, S87L, S87P, S87V, S87W, S87Y, R88V, R88W, V92C, I94L, V95I, V97A, V97I, S98P, A101G, S107A, S107M, Y109F, E114G, E114H, E114K, E114N, E114Q, E114R, E114S, E115C, E115Q, E115P, E115Q, L119A, L119V, L121M, D124C, D124E, D124H, D124N, G128A, G128E, G128H, G128T, G128Y, A130F, A130L, N131H, T132S, E134Q, K136N, K136R, I145C, M151G, M151H, M151K, M151N, M151Q, M151R, M151T, P153G, A156S, C158N, A156V, S160C, S160E, S160R, K161P, L165F, L165Y, Q166L, Q166M, Q166V, M168I, M168L, M168R, A173R, F176V, E178C, F180Y, V184F, V194I, I213E, D237A, D237C, D237K, D237S, D237T, S240H, A256D, S263D, S263E, R266Q, L269I, G270K, G270R, G270V, H271Q, H271W, E273T, E273V, R274A, R274E, R274L, R274P, R274Q, R274Y, G275A, V277E, V277K, V277M, V277R, Y280F, and Y280L (relative to SEQ ID NO:4).

In some embodiments, the engineered polypeptide having proline hydroxylase activity with improved properties as compared to SEQ ID NOS:4, 604, and/or 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:604 and one or more residue differences at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273. In some embodiments, the engineered polypeptide having proline hydroxylase activity with improved properties as compared to SEQ ID NOS:4, 604, and/or 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:604 and one or more residue differences selected from: 13K, 14G, 24T, 26A, 26G, 27T, 30N, 61D, 62D, 62E, 72E, 72V, 72Y, 76V, 77L, 81V, 82K, 82R, 86E, 97V, 114K, 114N, 114S, 127R, 127T, 128A, 128F, 128K, 128N, 128S, 142G, 142Q, 142S, 158N, 161G, 161P, 163E, 173K, 173Y, 175Q, 176D, 176K, 178R, 180M, 184L, 185V, 186G, 186R, 187C, 187H, 188I, 189A, 189H, 189I, 189P, 189V, 191L, 192A, 192P, 192Q, 192W, 193I, 195A, 195G, 198A, 200A, 207C, 207K, 207M, 207R, 207W, 209E, 209G, 210M, 211S, 213G, 213L, 213R, 215V, 217G, 218C, 218G, 222Q, 225A, 230E, 233E, 233Y, 236S, 238G, 238S, 238T, 240C, 240I, 240Q, 240R, 240T, 241C, 241I, 241L, 241V, 256R, 259G, 263D, 263G, 265C, 265V, 271R, 271W, 273G, and 273T (relative to SEQ ID NO:604). In some embodiments, the engineered polypeptide having proline hydroxylase activity with improved properties as compared to SEQ ID NOS:4, 604, and/or 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:604 and one or more residue differences selected from E13K, A14G, S24T, R26A, R26G, E27T, R30N, A57V, N61D, A62D, A62E, S72E, S72V, S72Y, L76V, N77L, E81V, T82K, T82R, C86E, R88H, A97V, E114K, E114N, E114S, S127R, S127T, G128A, G128F, G128K, G128N, G128S, L142G, L142Q, L142S, C158N, K161G, K161P, P163E, A173K, A173Y, A175Q, V176D, V176K, E178R, F180M, V184L, E185V, Q186G, Q186R, P187C, P187H, V188I, T189A, T189H, T189I, T189P, T189V, R191L, D192A, D192Q, D192P, D192W, M193I, D195A, D195G, K198A, L200A, G207C, G207K, G207M, G207R, G207W, L209E, L209G, G210M, F211S, I213G, I213L, I213R, I215V, E217G, A218C, A218G, E222Q, S225A, L230E, F233E, F233Y, C238G, C238S, C238T A236S, S240C, S240I, S240Q, S240R, S240T, M241C, M241I, M241L, M241V, A256R, E259G, S263D, S263G, E265C, E265V, H271R H271W, E273A, E273G, E273T (relative to SEQ ID NO:604). In some embodiments, the engineered proline hydroxylase polypeptide comprises an amino acid sequence having at least a combination of residues differences as compared to SEQ ID NO:604 selected from: E13K/E27T/R30N/A62D/T82R/C86E/E114S/G207W/A256R/S263D/H271W/E273T, E13K/R30N/A62D/E114S/L142S/A175Q/F180M/S263D/H271W/E273T, A14G/R30N/A62D/E114S/H271W/E273T, S24T/R26A/R30N/A62D/S72E/T82K/E114S/G128A/A173Y/V176D/I213L/S240T/H271W/E273T, S24T/R26A/R30N/A62D/S72E/T82K/E114S/G128A/F233Y/H271W/E273T, S24T/R26A/R30N/A62D/S72E/E114S/C158N/K161P/T189A/H271W/E273T, S24T/R26A/R30N/A62D/S72E/E114S/K161P/A173K/S240T/H271W/E273T, S24T/R26A/R30N/A62D/S72E/E114S/K161P/F233E/H271W/E273T, S24T/R26A/R30N/A62D/S72Y/E114S/G128A/T189A/S240C/H271W/E273T, S24T/R26A/R30N/A62D/T82K/E114S/G128A/K161P/A173Y/F180M/K198A/I213L/F233E/S240T/H271W/E273T, S24T/R26A/R30N/A62D/T82K/E114S/C158N/K161P/F180M/F233E/H271W/E273T, S24T/R26A/R30N/A62D/E114S/G128A/A173K/T189A/S225A/F233E/H271W/E273T, S24T/R26A/R30N/A62D/E114S/G128A/F180M/G207K/H271W/E273T, S24T/R26A/R30N/A62D/E114S/C158N/T189A/D192A/S225A/H271W/E273T, S24T/R26A/R30N/A62D/E114S/A173Y/H271W/E273T, S24T/R26A/R30N/A62D/E114S/T189A/H271W/E273T, S24T/R26G/R30N/A62D/S72E/T82K/E114S/G128A/C158N/K161P/T189A/S240T/M241C/H271W/E273T, S24T/R26G/R30N/A62D/S72E/E114S/C158N/A173K/I213L/F233Y/H271W/E273T, S24T/R30N/A62D/E114S/C158N/K161P/V176D/F233E/H271W/E273T, S24T/R30N/A62D/E114S/A173K/H271W/E273T, S24T/R30N/A62D/E114S/T189H/D192W/H271W/E273T, S24T/R30N/A62D/E114S/H271W/E273T, R26A/R30N/A62D/S72E/T82K/E114S/A173Y/D192A/S240T/H271W/E273T, R26A/R30N/A62D/S72E/E114S/G128A/C158N/K198A/H271W/E273T, R26A/R30N/A62D/S72E/E114S/C158N/K161P/D192P/H271W/E273T, R26A/R30N/A62D/S72E/E114S/C158N/D192P/S240T/M241C/H271W/E273T, R26A/R30N/A62D/S72E/E114S/K161P/S225A/H271W/E273T, R26A/R30N/A62D/S72E/E114S/K161P/H271W/E273T, R26A/R30N/A62D/S72E/E114S/A173Y/F180M/H271W/E273T, R26A/R30N/A62D/T82K/E114S/C158N/K161P/H271W/E273T, R26A/R30N/A62D/T82K/E114S/F233Y/H271W/E273T, R26A/R30N/A62D/E114S/K161P/T189A/D192P/F233E/S240T/H271W/E273T, R26A/R30N/A62D/E114S/A173Y/V176D/F180M/T189A/D192P/S225A/M241C/H271W/E27T, R26G/R30N/A62D/S72E/E114S/C158N/A173K/T189A/F233E/H271W/E273T, R26G/R30N/A62D/S72Y/E114S/C158N/H271W/E273T, R26G/R30N/A62D/T82K/E114S/K161P/A173Y/F180M/D192A/F233E/H271W/E273T, R26G/R30N/A62D/T82K/E114S/G128A/K161P/F180M/K198A/H271W/E273T, R26G/R30N/A62D/T82K/E114S/H271W/E273T, R26G/R30N/A62D/E114S/H271W/E273T, E27T/R30N/A62D/T82R/E114S/G128F/D192Q/A256R/H271W/E273T, E27T/R30N/A62D/T82R/E114S/L142S/D192Q/S263D/H271W/E273T, E27T/R30N/A62D/T82R/E114S/A175Q/D192Q/H271W/E273T, E27T/R30N/A62D/T82R/E114S/F180M/D192Q/H271W/E273T, E27T/R30N/A62D/E114S/G207W/A236S/S263D/H271W/E273T, E27T/R30N/A62D/E114S/G207W/S240R/S263D/H271W/E273T, E27T/R30N/A62D/E114S/A256R/H271W/E273T, E27T/R30N/A62D/E114S/S263D/H271W/E273T, R30N/A57V/A62E/L76V/A97V/E114S/H271R/E273T, R30N/N61D/A62D/E114S/H271W, R30N/N61D/A62E/ E114K/H271W/E273G, R30N/N61D/A62E/E114N/ H271W, R30N/N61D/A62D/E114N/H271W/E273T, R30N/ N61D/A62E/E114S/H271W/E273T, R30N/A62D/S72E/ T82K/E114S/A173K/F180M/G207R/I213L/S225A/F233E/ H271W/E273T, R30N/A62D/S72E/T82K/E114S/I213L/ F233E/H271W/E273T, R30N/A62D/S72E/E114S/C158N/ H271W/E273T, R30N/A62D/S72E/E114S/A173Y/T189A/ F233E/H271W/E273T, R30N/A62D/S72V/E114S/Q186G/ M193I/H271W/E273T, R30N/A62D/S72V/E114S/S240Q/ H271W/E273T, R30N/A62D/N77L/E114S/H271W/E273T, R30N/A62D/T82K/E114S/G128A/I213L/H271W/E273T, R30N/A62D/T82K/E114S/H271W/E273T, R30N/A62D/ T82R/E114S/G128F/S263D/H271W/E273T, R30N/A62D/ T82R/E114S/G128N/H271W/E273T, R30N/A62D/T82R/ E114S/L142S/A175Q/F180M/G207W/A256R/H271W/ E273T, R30N/A62D/T82R/E114S/A175Q/F180M/C238T/ S240R/S263D/H271W/E273T, R30N/A62D/T82R/E114S/ G207W/A256R/S263D/H271W/E273T, R30N/A62D/ T82R/E114S/G207W/S263D/H271W/E273T, R30N/A62D/ T82R/E114S/H271W/E273T, R30N/A62D/T82R/C86E/ E114S/R191L/D192Q/S263D/H271W/E273T, R30N/ A62D/C86E/E114S/G207W/S263D/H271W/E273T, R30N/ A62D/R88H/E114S/H271W/E273T R30N/A62D/E114S/ F211S/H271W/E273T, R30N/A62D/E114N/H271W/ E273T, R30N/A62D/E114S/S127R/K161G/E185V/ H271W/E273T, R30N/A62D/E114S/S127R/K161G/V188I/ T189P/H271W/E273T, R30N/A62D/E114S/S127R/ H271W/E273T, R30N/A62D/E114S/S127T/S240Q/ H271W/E273T, R30N/A62D/E114S/S127T/H271W/ E273T, R30N/A62D/E114S/G128F/L142Q/R191L/D192Q/ S263D/H271W/E273T, R30N/A62D/E114S/G128K/ L142S/A256R/S263D/H271W/E273T, R30N/A62D/ E114S/G128S/H271W/E273T R30N/A62D/E114S/P163E/ H271W/E273T, R30N/A62D/E114S/L142G/H271W/ E273T R30N/A62D/E114S/T189V/H271W/E273T, R30N/ A62D/E114S/L142Q/S263D/H271W/E273T, R30N/A62D/ E114S/L142Q/H271W/E273T, R30N/A62D/E114S/ C158N/A173Y/I213L/H271W/E273T, R30N/A62D/E114S/ C158N/H271W/E273T, R30N/A62D/E114S/K161G/ E185V/V188I/T189H/H271W/E273T, R30N/A62D/E114S/ K161G/E185V/T189H/H271W/E273T, R30N/A62D/ E114S/K161G/T189H/H271W/E273T, R30N/A62D/ E114S/A173Y/F180M/H271W/E273T, R30N/A62D/ E114S/A173Y/S263G/H271W/E273T, R30N/A62D/ E114S/A173Y/H271W/E273T, R30N/A62D/E114S/ A175Q/H271W/E273T, R30N/A62D/E114S/V176K/ P187H/S263G/H271W/E273T, R30N/A62D/E114S/ V176K/P187H/H271W/E273T, R30N/A62D/E114S/ E178R/V184L/Q186G/H271W/E273T, R30N/A62D/ E114S/F180M/H271W/E273T, R30N/A62D/E114S/ V184L/Q186G/T189I/G207R/H271W/E273T, R30N/ A62D/E114S/V184L/Q186G/T189I/S240Q/H271W/ E273T, R30N/A62D/E114S/V184L/Q186R/G207M/ H271W/E273T, R30N/A62D/E114S/V184L/T189I/G207K/ H271W/E273T, R30N/A62D/E114S/V184L/G207R/ H271W/E273T, R30N/A62D/E114S/V184L/G210M/ S240Q/H271W/E273T, R30N/A62D/E114S/V184L/T189I/ G207M/H271W/E273T, R30N/A62D/E114S/Q186G/ T189I/G207R/H271W/E273T, R30N/A62D/E114S/Q186G/ T189I/S240I/H271W/E273T, R30N/A62D/E114S/Q186R/ T189I/G207R/H271W/E273T, R30N/A62D/E114S/Q186R/ T189I/S240I/H271W/E273T, R30N/A62D/E114S/Q186R/ T189I/H271W/E273T, R30N/A62D/E114S/Q186R/ G207M/H271W/E273T, R30N/A62D/E114S/Q186R/ G207R/H271W/E273T, R30N/A62D/E114S/Q186R/ H271W/E273T, R30N/A62D/E114S/P187C/H271W/ E273T, R30N/A62D/E114S/P187H/S263G/H271W/E273T, R30N/A62D/E114S/P187H/H271W/E273T, R30N/A62D/ E114S/V188I/H271W/E273T, R30N/A62D/E114S/T189A/ E273A, R30N/A62D/E114S/T189H/H271W/E273T, R30N/ A62D/E114S/T189I/S240I/H271W/E273T, R30N/A62D/ E114S/T189I/H271W/E273T, R30N/A62D/E114S/R191L/ D192Q/G207W/S263D/H271W/E273T, R30N/A62D/ E114S/R191L/H271W/E273T, R30N/A62D/E114S/ D192Q/H271W/E273T, R30N/A62D/E114S/D195A/ H271W/E273T, R30N/A62D/E114S/D195G/H271W/ E273T, R30N/A62D/E114S/L200A/H271W/E273T, R30N/ A62D/E114S/G207C/H271W/E273T, R30N/A62D/E114S/ G207R/H271W/E273T, R30N/A62D/E114S/G207M/ H271W/E273T, R30N/A62D/E114S/G207W/H271W/ E273T, R30N/A62D/E114S/L209E/H271W/E273T, R30N/ A62D/E114S/L209G/H271W/E273T, R30N/A62D/E114S/ S240I/H271W/E273T, R30N/A62D/E114S/S240Q/S263G/ H271W/E273T, R30N/A62D/E114S/S240Q/H271W/ E273T, R30N/A62D/E114S/G210M/S240Q/H271W/ E273T, R30N/A62D/E114S/G210M/H271W/E273T, R30N/ A62D/E114S/I213G/H271W/E273T R30N/A62D/E114S/ A218C/H271W/E273T, R30N/A62D/E114S/I213L/F233E/ H271W/E273T, R30N/A62D/E114S/I213R/H271W/E273T, R30N/A62D/E114S/I215V/H271W/E273T, R30N/A62D/ E114S/E217G/H271W/E273T, R30N/A62D/E114S/L230E/ H271W/E273T, R30N/A62D/E114S/A218G/H271W/ E273T, R30N/A62D/E114S/E265C/H271W/E273T, R30N/ A62D/E114S/E222Q/H271W/E273T, R30N/A62D/E114S/ C238G/H271W/E273T, R30N/A62D/E114S/C238S/ H271W/E273T, R30N/A62D/E114S/S240Q/H271W/ E273T, R30N/A62D/E114S/S240T/H271W/E273T, R30N/ A62D/E114S/M241I/H271W/E273T, R30N/A62D/E114S/ M241V/H271W/E273T, R30N/A62D/E114S/E259G/ H271W/E273T, R30N/A62D/E114S/S263D/H271W/ E273T, R30N/A62D/E114S/S263G/H271W/E273T, R30N/ A62D/E114S/E265V/H271W/E273T, R30N/A62D/E81V/ E114S/H271W/E273T, R30N/A62D/E114S/H271W/ E273T, R30N/A62D/E114S/H271W/E273T, R30N/A62D/ H271R, R30N/A62E/E114N/H271W, R30N/A62E/E114S/ H271W/E273T, R30N/A62E/E114S/E273G, and A62D/ E114S/H271W.

In some embodiments, the engineered polypeptide having proline hydroxylase activity with improved properties as compared to SEQ ID NOS:4, 604, and/or 810, comprises an amino acid sequence having at least 80%, 85%, 86%, 87%, 88%, 89%, 90%, 91%, 92%, 93%, 94%, 95%, 96%, 97%, 98%, 99% or more identity to SEQ ID NO:810, and one or more residue differences as compared to SEQ ID NO:810 at residue positions selected from: 33, 40, 95, and 156. In some embodiments, the engineered proline hydroxylase comprises at least one of the following substitutions (relative to SEQ ID NO:810): 33G, 33H, 33K, 33T, 33W, 40Q, 40T, 95I, 156F, 156S, and 156V. In some embodiments, the engineered proline hydroxylase comprises at least one of the following substitutions (relative to SEQ ID NO:810): S33G, S33H, S33K, S33T, S33W, W40Q, W40T, V95I, A156F, A156S, and A156V.

As will be appreciated by the skilled artisan, in some embodiments, one or a combination of residue differences above that is selected can be kept constant (i.e., maintained) in the engineered proline hydroxylases as a core feature, and additional residue differences at other residue positions incorporated into the sequence to generate additional engineered proline hydroxylase polypeptides with improved properties. Accordingly, it is to be understood for any engineered proline hydroxylase containing one or a subset of the residue differences above, the present invention contemplates other engineered proline hydroxylases that comprise the one or subset of the residue differences, and additionally one or more residue differences at the other residue positions disclosed herein.

As noted above, the engineered polypeptides having proline hydroxylase activity are also capable of converting substrate compound (1) to product compound (2). In some embodiments, the engineered proline hydroxylase polypeptide is capable of converting the substrate compound (1) to the product compound (2) with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO:4, 604, and/or 810. In some embodiments, the engineered proline hydroxylase polypeptide capable of converting the substrate compound (1) to the product compound (2) with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold, or more activity relative to the activity of the reference polypeptide of SEQ ID NO:4, 604, and/or 810, comprises an amino acid sequence having one or more features selected from improved regioselectivity, improved activity, improved specific activity, and/or improved thermostability.

In some embodiments, the engineered proline hydroxylase polypeptide is capable of converting the substrate compound (1) to the product compound (2) with at least 1.2 fold the activity relative to SEQ ID NO:4, 604, and/or 810, and comprises an amino acid sequence selected from the even-numbered sequences in the following ranges: SEQ ID NO:6-602, 606-808, and 812-1004.

In some embodiments, the engineered proline hydroxylase polypeptide is capable of converting the substrate compound (1) to the product compound (2) with at least 2 fold the activity relative to SEQ ID NO:4, 604, and/or 810, and comprises an amino acid sequence having one or more residue differences as provided herein (as compared to SEQ ID NO:4, 604, and/or 810, as applicable).

In some embodiments, the engineered proline hydroxylase polypeptide capable of converting the substrate compound (1) to the product compound (2) with at least 2 fold the activity relative to SEQ ID NO:4, 604, and/or 810, comprises an amino acid sequence selected from: the even-numbered sequences in the following ranges: SEQ ID NO:6-602, 606-808, and 812-1004.

In some embodiments, the engineered proline hydroxylase polypeptide is capable of converting at least 50% or more, 60% or more, 70% or more, 89% or more, 90% or more, 91% or more, 92% or more, 93% or more, 94% or more, or 95% or more of compound (1) to compound (2) in 120 h or less, 72 h or less, 48 h or less, or 24 or less, at a substrate loading of about 100 g/L, about 50 g/L, or about 20 g/L under HTP assay conditions, under SFP assay conditions, or DSP assay conditions. In some embodiments, the engineered proline hydroxylase polypeptide is capable of converting at least 50% or more of compound (1) to compound (2) in 24 h or less at a substrate loading of about 20 g/L under DSP Assay conditions at about 25° C.

In some embodiments, the engineered proline hydroxylase has an amino acid sequence comprising one or more residue differences as compared to SEQ ID NO:4, 604, and/or 810, that increase expression of the engineered proline hydroxylase activity in a bacterial host cell, particularly in E. coli.

In some embodiments, the engineered proline hydroxylase polypeptide with improved properties in the conversion of compound (2) to compound (1) has an amino acid sequence comprising a sequence selected from the even-numbered sequences in the following ranges: SEQ ID NO:6-602, 606-808, and 812-1004.

In some embodiments, the engineered polypeptide having proline hydroxylase activity, comprises an amino acid sequence having at least 80%, 85%, 86%, 87%, 88%, 89%, 90%, 91%, 92%, 93%, 94%, 95%, 96%, 97%, 98%, or 99% identity to one of the even-numbered sequences in the following ranges: SEQ ID NO:6-602, 606-808, and 812-1004, and the amino acid residue differences as compared to SEQ ID NO:4, 604, and/or 810, present in any one of the even-numbered sequences in the following ranges: SEQ ID NO:6-602, 606-808, and 812-1004, as provided in Tables 4.1, 4.2, 4.3, 4.4, 4.5, 4.6, 4.7, 4.8, 5.1, 6.1, 6.2, and/or 6.3.

In addition to the residue positions specified above, any of the engineered proline hydroxylase polypeptides disclosed herein can further comprise other residue differences relative to SEQ ID NO:4, 604, and/or 810, at other residue positions (i.e., residue positions other than those included in any of the even-numbered sequences in the following ranges: SEQ ID NO:6-602, 606-808, and 812-1004). Residue differences at these other residue positions can provide for additional variations in the amino acid sequence without adversely affecting the ability of the polypeptide to carry out the conversion of proline to cis-4-hydroxyproline as well as conversion of compound (1) to compound (2). Accordingly, in some embodiments, in addition to the amino acid residue differences present in any one of the engineered proline hydroxylase polypeptides selected from the even-numbered sequences in the following ranges: SEQ ID NO:6-602, 606-808, and 812-1004, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO:4, 604, and/or 810. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue difference at these other positions can be conservative changes or non-conservative changes. In some embodiments, the residue differences can comprise conservative substitutions and non-conservative substitutions as compared to the naturally occurring proline hydroxylase polypeptide of SEQ ID NO:4, 604, and/or 810.

In some embodiments, the present invention also provides engineered polypeptides that comprise a fragment of any of the engineered proline hydroxylase polypeptides described herein that retains the functional activity and/or improved property of that engineered proline hydroxylase. Accordingly, in some embodiments, the present invention provides a polypeptide fragment capable of converting compound (1) to compound (2) under suitable reaction conditions, wherein the fragment comprises at least about 80%, 90%, 95%, 96%, 97%, 98%, or 99% of a full-length amino acid sequence of an engineered proline hydroxylase polypeptide of the present invention, such as an exemplary engineered proline hydroxylase polypeptide selected from the even-numbered sequences in the following ranges: SEQ ID NO:6-602, 606-808, and 812-1004.

In some embodiments, the engineered proline hydroxylase polypeptide can have an amino acid sequence comprising a deletion in any one of the engineered proline hydroxylase polypeptide sequences described herein, such as the exemplary engineered polypeptides of the even-numbered sequences in the following ranges: SEQ ID NO:6-602, 606-808, and 812-1004.

Thus, for each and every embodiment of the engineered proline hydroxylase polypeptides of the invention, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 20% of the total number of amino acids, or up to 30% of the total number of amino acids of the proline hydroxylase polypeptides, where the associated functional activity and/or improved properties of the engineered proline hydroxylase described herein are maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered proline hydroxylase polypeptide herein can have an amino acid sequence comprising an insertion as compared to any one of the engineered proline hydroxylase polypeptides described herein, such as the exemplary engineered polypeptides of the even-numbered sequences in the following ranges: SEQ ID NO:6-602, 606-808, and 812-1004. Thus, for each and every embodiment of the proline hydroxylase polypeptides of the invention, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered proline hydroxylase described herein is maintained. The insertions can be to amino or carboxy terminus, or internal portions of the proline hydroxylase polypeptide.

In some embodiments, the engineered proline hydroxylase polypeptide herein can have an amino acid sequence comprising a sequence selected from the even-numbered sequences in the following ranges: SEQ ID NO:6-602, 606-808, and 812-1004, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the number of amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides are provided in Tables 4.1, 4.2, 4.3, 4.4, 4.5, 4.6, 4.7, 4.8, 5.1, 6.1, 6.2, and/or 6.3, and as described in Examples 4, 5, and 6.

In some embodiments, the polypeptides of the present invention are fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Pat); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aGly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (See e.g., the various amino acids provided in Fasman, *CRC Practical Handbook of Biochemistry and Molecular Biology*, CRC Press, Boca Raton, Fla., pp. 3-70 [1989], and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys(methylbenzyl), Cys (nitropyridinesulfenyl), Glu(δ-benzylester), Gln(xanthyl), Asn(N-δ-xanthyl), His(bom), His (benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having proline hydroxylase activity of the present invention can be immobilized on a solid support such that they retain their improved activity, stereoselectivity, and/or other improved properties relative to the reference polypeptide of SEQ ID NO: 4, 604, and/or 810. In such embodiments, the immobilized polypeptides can facilitate the biocatalytic conversion of the substrate compounds or other suitable substrates to the product and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the proline hydroxylase polypeptides of the present invention can be carried out using the same proline hydroxylase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art (See e.g., Yi et al., Proc. Biochem., 42(5): 895-898 [2007]; Martin et al., Appl. Microbiol. Biotechnol., 76(4): 843-851 [2007]; Koszelewski et al., J. Mol. Cat. B: Enzymatic, 63: 39-44 [2010]; Truppo et al., Org. Proc. Res. Dev., published online: dx.doi.org/10.1021/op200157c; Hermanson, *Bioconjugate Techniques*, 2$^{nd}$ ed., Academic Press, Cambridge, Mass. [2008]; Mateo et al., Biotechnol. Prog., 18(3):629-34 [2002]; and "Bioconjugation Protocols: Strategies and Methods," In *Methods in Molecular Biology*, Niemeyer (ed.), Humana Press, New York, N.Y. [2004]; the disclosures of each which are incorporated by reference herein). Solid supports useful for immobilizing the engineered proline hydroxylases of the present invention include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered proline hydroxylase polypeptides of the present invention include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein are provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present invention include arrays comprising a plurality of different proline hydroxylase polypeptides at different addressable position, wherein the different polypeptides are different variants of a reference sequence each having at least one different improved enzyme property. In some embodiments, a plurality of polypeptides immobilized on solid supports are configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are known in the art (See e.g., WO2009/008908A2).

Polynucleotides Encoding Engineered Proline Hydroxylases, Expression Vectors and Host Cells In another aspect, the present invention provides polynucleotides encoding the engineered proline hydroxylase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered proline hydroxylase are introduced into appropriate host cells to express the corresponding proline hydroxylase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved proline hydroxylase enzymes. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 4.1, 4.2, 4.3, 4.4, 4.5, 4.6, 4.7, 4.8, 5.1, 6.1, 6.2, and/or 6.3, and disclosed in the sequence listing incorporated by reference herein as the even-numbered sequences in the following ranges: SEQ ID NO:6-602, 606-808, and 812-1004.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the proline hydroxylases since the natural sequence will comprise preferred codons and because use of preferred codons may not be required for all amino acid residues. Consequently, codon optimized polynucleotides encoding the proline hydroxylase enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the naturally occurring proline hydroxylase polypeptide amino acid sequence, as represented by SEQ ID NO:4, 604, and/or 810. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences encoding the even-numbered sequences in the following ranges: SEQ ID NO:6-602, 606-808, and 812-1004. In some embodiments, the polynucleotide has a nucleic acid sequence comprising at least 80%, 85%, 90%, 91%, 92%, 93%, 94%, 95%, 96%, 97%, 98%, 99% or more identity to the codon optimized nucleic acid sequences in the odd-numbered sequences in the following ranges: SEQ ID NO:5-601, 605-807, and 811-1003. The codon optimized sequences of the odd-numbered sequences in the following ranges: SEQ ID NO:5-601, 605-807, and 811-1003, enhance expression of the encoded, wild-type proline hydroxylase, providing preparations of enzyme capable of converting in vitro over 80% of compound (1) to compound (2) under mini-DSP Assay conditions, and converting over 45% of compound (1) to compound (2) under DSP Assay conditions. In some embodiments, the codon optimized polynucleotide sequence can enhance expression of the proline hydroxylase by at least 1.2 fold, 1.5 fold or 2 fold or greater as compared to the naturally occurring polynucleotide sequence from *Sinorhizobium meliloti*.

In some embodiments, the polynucleotides are capable of hybridizing under highly stringent conditions to a reference sequence selected from the odd-numbered sequences in SEQ ID NOS:3-1003, or a complement thereof, and encodes a polypeptide having proline hydroxylase activity.

In some embodiments, as described above, the polynucleotide encodes an engineered polypeptide having proline hydroxylase activity with improved properties as compared to SEQ ID NO:4, 604, and/or 810, where the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO:4, 604, and/or 810, and one or more residue differences as compared to SEQ ID NO:4, 604, and/or 810, selected from the even-numbered sequences in the following ranges: SEQ ID NO:6-602, 606-808, and 812-1004. In some embodiments, the reference amino acid sequence is selected from the even-numbered sequences in the following ranges: SEQ ID NO:6-602, 606-808, and 812-1004. In some embodiments, the reference amino acid sequence is SEQ ID NO:4. In some embodiments, the reference amino acid sequence is SEQ ID NO:604. In some further embodiments, the reference amino acid sequence is SEQ ID NO:810.

In some embodiments, the polynucleotide encodes a proline hydroxylase polypeptide capable of converting substrate compound (1) to product compound (2) with improved properties as compared to SEQ ID NO:4, 604, and/or 810, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4, 604, and/or 810, and one or more residue differences as compared to SEQ ID NO: 4, 604, and/or 810, at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280; or at residue positions selected from 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273; or at residue positions selected from 33, 40, 95, and 156.

In some embodiments, the polynucleotide encodes a proline hydroxylase polypeptide capable of converting substrate compound (1) to product compound (2) with improved properties as compared to SEQ ID NO:4, 604, and/or 810, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4, 604, and/or 810, and one or more residue differences as compared to SEQ ID NO: 4, 604, and/or 810, at residue positions selected from: 2, 4, 8, 10, 13, 14, 15, 24, 26, 27, 30, 33, 36, 37, 39, 40, 42, 43, 44, 45, 48, 50, 52, 55, 56, 57, 58, 61, 62, 63, 71, 72, 76, 77, 81, 82, 86, 87, 88, 92, 94, 95, 97, 98, 101, 107, 109, 114, 115, 119, 121, 124, 127, 128, 130, 131, 132, 134, 136, 142, 145, 151, 153, 156, 158, 160, 161, 163, 165, 166, 168, 173, 175, 176, 178, 180, 184, 185, 186, 187, 188, 189, 191, 192, 194, 195, 198, 200, 207, 209, 210, 211, 213, 215, 217, 218, 222, 225, 230, 233, 236, 237, 238, 240, 241, 256, 259, 263, 265, 266, 269, 270, 271, 273, 274, 275, and 280.

In some embodiments, the polynucleotide encodes a proline hydroxylase polypeptide capable of converting substrate compound (1) to product compound (2) with improved properties as compared to SEQ ID NO:4, 604, and/or 810, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:4, 604, and/or 810, and at least a combination of residue differences as compared to SEQ ID NO: 604, and/or 810, selected from:

(a) 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280; (b) 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273; or (c) 33, 40, 95, and 156.

In some embodiments, the polynucleotide encodes an engineered polypeptide having proline hydroxylase activity with improved properties as compared to SEQ ID NOS:4, 604, and/or 810, comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:604 and one or more residue differences at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273.

In some embodiments, the polynucleotide encodes an engineered proline hydroxylase polypeptide capable of converting substrate compound (1) to product compound (2) with improved enzyme properties as compared to the reference polypeptide of SEQ ID NO:4, 604, and/or 810, wherein the polypeptide comprises an amino acid sequence having at least 80%, 85%, 86%, 87%, 88%, 89%, 90%, 91%, 92%, 93%, 94%, 95%, 96%, 97%, 98%, or 99% identity to a reference polypeptide selected from any one of the even-numbered sequences in the following ranges: SEQ ID NO:6-602, 606-808, and 812-1004, with the proviso that the amino acid sequence comprises any one of the set of residue differences as compared to SEQ ID NO: 4, 604, and/or 810 contained in any one of the polypeptide sequences from the even-numbered sequences in the following ranges: SEQ ID NO:6-602, 606-808, and 812-1004, as listed in Tables 4.1, 4.2, 4.3, 4.4, 4.5, 4.6, 4.7, 4.8, 5.1, 6.1, 6.2, and/or 6.3.

In some embodiments, the polynucleotide encoding the engineered proline hydroxylase comprises an polynucleotide sequence selected from the odd-numbered sequences in the following ranges: SEQ ID NO:5-601, 605-807, and 811-1003.

In some embodiments, the polynucleotides are capable of hybridizing under highly stringent conditions to a reference polynucleotide sequence selected from the odd-numbered sequences in the following ranges: SEQ ID NO:5-601, 605-807, and 811-1003, or a complement thereof, and encodes a polypeptide having proline hydroxylase activity with one or more of the improved properties described herein. In some embodiments, the polynucleotide capable of hybridizing under highly stringent conditions encodes a proline hydroxylase polypeptide comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:604, that has an amino acid sequence comprising one or more residue differences as compared to SEQ ID NO:604, at residue positions selected from: 2, 4, 8, 10, 13, 14, 15, 24, 26, 27, 30, 33, 36, 37, 39, 40, 42, 43, 44, 45, 48, 50, 52, 55, 56, 57, 58, 61, 62, 63, 71, 72, 76, 77, 81, 82, 86, 87, 88, 92, 94, 95, 97, 98, 101, 107, 109, 114, 115, 119, 121, 124, 127, 128, 130, 131, 132, 134, 136, 142, 145, 151, 153, 156, 158, 160, 161, 163, 165, 166, 168, 173, 175, 176, 178, 180, 184, 185, 186, 187, 188, 189, 191, 192, 194, 195, 198, 200, 207, 209, 210, 211, 213, 215, 217, 218, 222, 225, 230, 233, 236, 237, 238, 240, 241, 256, 259, 263, 265, 266, 269, 270, 271, 273, 274, 275, and 280.

In some embodiments, the polynucleotide capable of hybridizing under highly stringent conditions encodes an engineered polypeptide having proline hydroxylase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:4, and one or more residue differences as compared to SEQ ID NO:4 at residue positions selected from 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280.

In some embodiments, the polynucleotide capable of hybridizing under highly stringent conditions encodes an engineered polypeptide having proline hydroxylase activity with improved properties comprising an amino acid sequence having at least 80%, 85%, 86%, 87%, 88%, 89%, 90%, 91%, 92%, 93%, 94%, 95%, 96%, 97%, 98%, 99% or more identity to SEQ ID NO:810, and one or more residue differences as compared to SEQ ID NO:810 at residue positions selected from 33, 40, 95, and 156.

In some embodiments, the polynucleotides encode the polypeptides described herein but have at least about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered proline hydroxylase. In some embodiments, the reference polynucleotide sequence is selected from the odd-numbered sequences in the range SEQ ID NO:3-1003.

In some embodiments, an isolated polynucleotide encoding any of the engineered proline hydroxylase polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. For bacterial host cells, suitable promoters for directing transcription of the nucleic acid constructs of the present application, include, but are not limited to the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad.

Sci. USA 80: 21-25 [1983]). Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/ glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]).

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered proline hydroxylase polypeptides provided herein. Effective signal peptide coding regions for bacterial host cells include, but are not limited to the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide. The propeptide coding region includes, but is not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention also provides a recombinant expression vector comprising a polynucleotide encoding an engineered proline hydroxylase polypeptide, and one or more expression regulating regions such as a promoter and a terminator, a replication origin, etc., depending on the type of hosts into which they are to be introduced. In some embodiments, the various nucleic acid and control sequences described above are combined together to produce a recombinant expression vector which includes one or more convenient restriction sites to allow for insertion or substitution of the nucleic acid sequence encoding the variant proline hydroxylase polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant proline hydroxylase polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered proline hydroxylase polypeptide of the present application, the polynucleotide being operatively linked to one or more control sequences for expression of the engineered proline hydroxylase enzyme(s) in the host cell. Host cells for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* and *Pichia pastoris* [ATCC Accession No. 201178]); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* strains (e.g., W3110 (ΔfhuA) and BL21).

Accordingly, in another aspect, the present invention provides methods for producing the engineered proline hydroxylase polypeptides, where the methods comprise culturing a host cell capable of expressing a polynucleotide encoding the engineered proline hydroxylase polypeptide under conditions suitable for expression of the polypeptide. In some embodiments, the methods further comprise the steps of isolating and/or purifying the proline hydroxylase polypeptides, as described herein.

Appropriate culture media and growth conditions for the above-described host cells are well known in the art. Polynucleotides for expression of the proline hydroxylase polypeptides may be introduced into cells by various methods known in the art. Techniques include, among others, electroporation, biolistic particle bombardment, liposome mediated transfection, calcium chloride transfection, and protoplast fusion.

The engineered proline hydroxylase with the properties disclosed herein can be obtained by subjecting the polynucleotide encoding the naturally occurring or engineered proline hydroxylase polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,830,721, 6,132,970, 6,420,175, 6,277,638, 6,365,408, 6,602,986, 7,288,375, 6,287,861, 6,297,053, 6,576,467, 6,444,468, 5,811238, 6,117,679, 6,165,793, 6,180,406, 6,291,242, 6,995,017, 6,395,547, 6,506,602, 6,519,065, 6,506,603, 6,413,774, 6,573,098, 6,323,030, 6,344,356, 6,372,497, 7,868,138, 5,834,252, 5,928,905, 6,489,146, 6,096,548, 6,387,702, 6,391,552, 6,358,742, 6,482,647, 6,335,160, 6,653,072, 6,355,484, 6,303,344, 6,319,713, 6,613,514, 6,455,253, 6,579,678, 6,586,182, 6,406,855, 6,946,296, 7,534,564, 7,776,598, 5,837,458, 6,391,640, 6,309,883, 7,105,297, 7,795,030, 6,326,204, 6,251,674, 6,716,631, 6,528,311, 6,287,862, 6,335,198, 6,352,859, 6,379,964, 7,148,054, 7,629,170, 7,620,500, 6,365,377, 6,358,740, 6,406,910, 6,413,745, 6,436,675, 6,961,664, 6,537,746, 7,430,477, 7,873,499, 7,702,464, 7,783,428, 7,747,391, 7,747,393, 7,751,986, 6,376,246, 6,426,224, 6,423,542, 6,479,652, 6,319,714, 6,521,453, 6,368,861, 7,421,347, 7,058,515, 7,024,312, 7,620,502, 7,853,410, 7,957,912, 7,904,249, 8,383,346, 8,504,498, 8,768,871, 8,762,066, 8,849,575, and all related non-US counterparts; Ling et al., Anal. Biochem., 254:157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; WO 2009/152336, WO 2009/102901, WO 2009/102899, WO 2011/035105, WO 2013/138339, WO 2013/003290, WO 2014/120819, WO 2014/120821, WO 2015/0134315, and WO 2015/048573, all of which are incorporated herein by reference).

In some embodiments, the enzyme clones obtained following mutagenesis treatment are screened by subjecting the enzymes to a defined temperature (or other assay conditions, such as testing the enzyme's activity over a broad range of substrates) and measuring the amount of enzyme activity remaining after heat treatments or other assay conditions. Clones containing a polynucleotide encoding a proline hydroxylase polypeptide are then sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

In some embodiments, the clones obtained following mutagenesis treatment can be screened for engineered proline hydroxylases having one or more desired improved enzyme properties (e.g., improved regioselectivity). Measuring enzyme activity from the expression libraries can be performed using the standard biochemistry techniques, such as HPLC analysis and/or derivatization of products (pre or post separation), for example, using dansyl chloride or OPA (See e.g., Yaegaki et al., J Chromatogr. 356(1):163-70 [1986]).

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides encoding portions of the proline hydroxylase can be prepared by chemical synthesis as known in the art (e.g., the classical phosphoramidite method of Beaucage et al., Tet. Lett. 22:1859-69 [1981], or the method described by Matthes et al., EMBO J. 3:801-05 [1984]) as typically practiced in automated synthetic methods. According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered proline hydroxylases with improved properties.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO:4-1004, and having one or more residue differences as compared to SEQ ID NO:4 at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO:4-1004, and having one or more residue differences as compared to SEQ ID NO:604 at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence having at least about 80%, 85%, 86%, 87%, 88%, 89%, 90%, 91%, 92%, 93%, 94%, 95%, 96%, 97%, 98%, or 99% or more sequence identity to an amino acid sequence selected from the even-numbered sequences of SEQ ID NO:4-1004, and having one or more residue differences as compared to SEQ ID NO:810 at residue positions selected from 33, 40, 95, and 156; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO:4-1004, and having one or more residue differences as compared to SEQ ID NO:4 at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO:4-1004, and having one or more residue differences as compared to SEQ ID NO:604 at residue positions selected from: 13, 14, 24, 26, 27, 30, 57, 61, 62, 72, 76, 77, 81, 82, 86, 88, 97, 114, 127, 128, 142, 158, 161, 163, 173, 175, 176, 178, 180, 184, 185, 186, 187, 188, 189, 191, 192, 195, 198, 200, 207, 209, 210, 211, 213, 215, 217, 218, 222, 225, 230, 233, 236, 238, 240, 241, 256, 259, 263, 265, 271, and 273; and (b) expressing the proline hydroxylase polypeptide encoded by the polynucleotide.

Accordingly, in some embodiments, a method for preparing the engineered proline hydroxylases polypeptide comprises: (a) synthesizing a polynucleotide encoding a polypeptide comprising an amino acid sequence selected from the even-numbered sequences of SEQ ID NO:4-1004, and having one or more residue differences as compared to SEQ ID NO:810 at residue positions selected from 33, 40, 95, and 156; and (b) expressing the proline hydroxylase polypeptide encoded by the polynucleotide.

In some embodiments of the method, the polynucleotide encodes an engineered proline hydroxylase that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In some embodiments, any of the engineered proline hydroxylase enzymes expressed in a host cell can be recovered from the cells and/or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available (e.g., CelLytic B™, Sigma-Aldrich, St. Louis Mo.).

Chromatographic techniques for isolation of the proline hydroxylase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved proline hydroxylase enzymes. For affinity chromatography purification, any antibody which specifically binds the proline hydroxylase polypeptide may be used. For the production of antibodies, various host animals, including but not limited to rabbits, mice, rats, etc., may be immunized by injection with a proline hydroxylase polypeptide, or a fragment thereof. The proline hydroxylase polypeptide or fragment may be attached to a suitable carrier, such as BSA, by means of a side chain functional group or linkers attached to a side chain functional group. In some embodiments, the affinity purification can use a specific ligand bound by the proline hydroxylase, such as poly(L-proline) or dye affinity column (See e.g., EP0641862; Stellwagen, "Dye Affinity Chromatography," In *Current Protocols in Protein Science*, Unit 9.2-9.2.16 [2001]).

Methods of Using the Engineered Proline Hydroxylase Enzymes

In some embodiments, the proline hydroxylases described herein find use processes for converting a suitable substrate to its hydroxylated product. Generally, the process for performing the hydroxylation reaction comprises contacting or incubating the substrate compound in presence of a co-substrate, such as α-ketoglutarate, with a proline hydroxylase polypeptide of the invention under reaction conditions suitable for formation of the hydroxylated product, as shown in Scheme 1, above.

In the embodiments provided herein and illustrated in the Examples, various ranges of suitable reaction conditions that can be used in the processes, include but are not limited to, substrate loading, co-substrate loading, reductant, divalent transition metal, pH, temperature, buffer, solvent system, polypeptide loading, and reaction time. Further suitable reaction conditions for carrying out the process for biocatalytic conversion of substrate compounds to product compounds using an engineered proline hydroxylase polypeptide described herein can be readily optimized in view of the guidance provided herein by routine experimentation that includes, but is not limited to, contacting the engineered proline hydroxylase polypeptide and substrate compound under experimental reaction conditions of concentration, pH, temperature, and solvent conditions, and detecting the product compound.

Suitable reaction conditions using the engineered proline hydroxylase polypeptides typically comprise a co-substrate, which is used stoichiometrically in the hydroxylation reaction. Generally, the co-substrate for proline hydroxylases is α-ketoglutarate, also referred to as α-ketoglutaric acid and 2-oxoglutaric acid. Other analogs of α-ketoglutarate that are capable of serving as co-substrates for proline hydroxylases can be used. An exemplary analog that may serve as a co-substrate is α-oxoadipate. Because the co-substrate is used stoichiometrically, the co-substrate is present at an equimolar or higher amount than that of the substrate compound (i.e., the molar concentration of co-substrate is equivalent to or higher than the molar concentration of substrate compound). In some embodiments, the suitable reaction conditions can comprise a co-substrate molar concentration of at least 1 fold, 1.5 fold, 2 fold, 3 fold 4 fold or 5 fold or more than the molar concentration of the substrate compound. In some embodiments, the suitable reaction conditions can comprise a co-substrate concentration, particularly alpha-ketoglutarate, of about 0.001 M to about 2 M, 0.01 M to about 2 M, 0.1 M to about 2 M, 0.2 M to about 2 M, about 0.5 M to about 2 M, or about 1 M to about 2 M. In some embodiments, the reaction conditions comprise a co-substrate concentration of about 0.001, 0.01, 0.1, 0.2, 0.3, 0.4, 0.5, 0.6, 0.7, 0.8, 1, 1.5, or 2 M. In some embodiments, additional co-substrate can be added during the reaction.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 200 g/L, 1 to about 200 g/L, 5 to about 150 g/L, about 10 to about 100 g/L, 20 to about 100 g/L or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (1), however it also contemplated that the equivalent molar amounts of various hydrates and salts of compound (1) also can be used in the process.

In carrying out the proline hydroxylase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered proline hydroxylase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered proline hydroxylase polypeptides can be transformed into host cell separately or together into the same host cell. For example, in some embodiments one set of host cells can be transformed with gene(s) encoding one engineered proline hydroxylase polypeptide and another set can be transformed with gene(s) encoding another engineered proline hydroxylase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered proline hydroxylase polypeptide. In some embodiments the engineered polypeptides can be expressed in the form of secreted polypeptides and the culture medium containing the secreted polypeptides can be used for the proline hydroxylase reaction.

In some embodiments, the improved activity and/or stereoselectivity of the engineered proline hydroxylase polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptide is present at about 0.01 g/L to about 50 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the proline hydroxylase polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

In some embodiments, the reactions conditions also comprise a divalent transition metal capable of serving as a cofactor in the oxidation reaction. Generally, the divalent transition metal co-factor is ferrous ion (i.e., $Fe^{+2}$). The ferrous ion may be provided in various forms, such as ferrous sulfate ($FeSO_4$), ferrous chloride ($FeCl_2$), ferrous carbonate ($FeCO_3$), and the salts of organic acids such as citrates, lactates and fumarates. An exemplary source of ferrous sulfate is Mohr's salt, which is ferrous ammonium sulfate $(NH_4)_2Fe(SO_4)_2$ and is available in anhydrous and hydrated (i.e., hexahydrate) forms. While ferrous ion is the transition metal co-factor found in the naturally occurring proline hydroxylase and functions efficiently in the engineered enzymes, it is to be understood that other divalent transition metals capable of acting as a co-factor can be used in the processes. In some embodiments, the divalent transition metal co-factor can comprise $Mn^{+2}$ and $Cr^{+2}$. In some embodiments, the reaction conditions can comprises a divalent transition metal cofactor, particularly $Fe^{+2}$, at a concentration of about 0.1 mM to 10 mM, 0.1 mM to about 5 mM, 0.5 mM to about 5 mM, about 0.5 mM to about 3 mM or about 1 mM to about 2 mM. In some embodiments, the reaction conditions comprise a divalent transition metal co-factor concentration of about 0.1 mM, 0.2 mM, 0.5 mM, 1 mM, 1.5 mM, 2 mM, 3 mM, 5 mM, 7.5 mM or 10 mM. In some embodiments, higher concentrations of divalent transition metal cofactor can be used, for example up to 50 mM or up to 100 mM.

In some embodiments, the reaction conditions can further comprise a reductant capable of reducing ferric ion, $Fe^{+3}$ to ferrous ion, $Fe^{+2}$. In some embodiments, the reductant comprises ascorbic acid, typically L-ascorbic acid. While ascorbic acid is not required for the hydroxylation reaction, enzymatic activity is enhanced in its presence. Without being bound by theory, the ascorbate is believed to maintain or regenerate the enzyme-$Fe^{+2}$ form, which is the active form mediating the hydroxylation reaction. Generally, the reaction conditions can comprise an ascorbic acid concentration that corresponds proportionately to the substrate loading. In some embodiments, the ascorbic acid is present in at least about 0.1 fold, 0.2 fold 0.3 fold, 0.5 fold, 0.75 fold, 1 fold, 1.5 fold, or at least 2 fold the molar amount of substrate. In some embodiments, the reductant, particularly L-ascorbic acid, is at a concentration of about 0.001 M to about 0.5 M, about 0.01M to about 0.5 M, about 0.01 M to about 0.4 M, about 0.1 to about 0.4 M, or about 0.1 to about 0.3 M. In some embodiments, the reductant, particularly ascorbic acid, is at a concentration of about 0.001 M, 0.005 M, 0.01 M, 0.02M, 0.03 M, 0.05 M, 0.1 M, 0.15 M, 0.2 M, 0.3 M, 0.4 M, or 0.5 M.

In some embodiments, the reaction conditions comprise molecular oxygen (i.e., $O_2$). Without being bound by theory, one atom of oxygen from molecular oxygen is incorporated into the substrate compound to form the hydroxylated product compound. The $O_2$ may be present naturally in the reaction solution, or introduced and/or supplemented into the reaction artificially. In some embodiments, the reaction conditions can comprise forced aeration (e.g., sparging) with air, $O_2$ gas, or other $O_2$-containing gases. In some embodiments, the $O_2$ in the reaction can be increased by increasing the pressure of the reaction with $O_2$ or an $O_2$-containing gas. This can be done by carrying out the reaction in a vessel that can be pressurized with $O_2$ gas. In some embodiments, the $O_2$ gas can be sparged through the reaction solution at a rate of at least 1 liter per hour (L/h), at least 2 L/h, at least 3 L/h, at least 4 L/h, at least 5 L/h, or greater. In some embodiments, the $O_2$ gas can be sparged through the reaction solution at a rate of between about 1 L/h and 10 L/h, between about 2 L/h and 7 L/h, or between about 3 L/h and 5 L/h.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the buffer is phosphate. In some embodiments of the process, the suitable reaction conditions comprise a buffer (e.g., phosphate) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., phosphate) concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

The processes of the invention are generally carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered proline hydroxylase polypeptides can be carried out in an aqueous co-solvent system comprising an organic solvent (e.g., ethanol, isopropanol (IPA), dimethyl sulfoxide (DMSO), dimethylformamide (DMF) ethyl acetate, butyl acetate, 1-octanol, heptane, octane, methyl t butyl ether (MTBE), toluene, and the like), ionic or polar solvents (e.g., 1-ethyl 4 methylimidazolium tetrafluoroborate, 1-butyl-3-methylimidazolium tetrafluoroborate, 1-butyl 3 methylimidazolium hexafluorophosphate, glycerol, polyethylene glycol, and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the proline hydroxylase enzyme under the reaction conditions. Appropriate co-solvent systems can be readily identified by measuring the enzymatic activity of the specified engineered proline hydroxylase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising DMSO at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the hydroxylase reaction will generally vary depending on the quantities of product desired, and concomitantly the amount of proline hydroxylase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, proline hydroxylase, and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the proline hydroxylase, and cofactor may be added and mixed into the aqueous phase first. The organic phase may then be added and mixed in, followed by addition of the proline hydroxylase substrate and co-substrate. Alternatively, the proline hydroxylase substrate may be premixed in the organic phase, prior to addition to the aqueous phase.

The hydroxylation process is generally allowed to proceed until further conversion of substrate to hydroxylated product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading of at least about 5 g/L, 10 g/L, 20 g/L, 30 g/L, 40 g/L, 50 g/L, 60 g/L, 70 g/L, 100 g/L, or more, and wherein the method results in at least about 50%, 60%, 70%, 80%, 90%, 95% or greater conversion of substrate compound to product compound in about 48 h or less, in about 36 h or less, or in about 24 h or less.

The engineered proline hydroxylase polypeptides of the present invention when used in the process under suitable reaction conditions result in an excess of the cis-hydroxylated product in at least 90%, 95%, 96%, 97%, 98%, 99%, or greater diastereomeric excess over the trans-hydroxylated product. In some embodiments, no detectable amount of compound trans-hydroxylated product is formed.

In further embodiments of the processes for converting substrate compound to hydroxylated product compound using the engineered proline hydroxylase polypeptides, the suitable reaction conditions can comprise an initial substrate loading to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 20 g/L, 30 g/L, or 40 g/L. This addition of polypeptide is then followed by continuous addition of further substrate to the solution at a rate of about 2 g/L/h, 4 g/L/h, or 6 g/L/h until a much higher final substrate loading of at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having an initial substrate loading of at least about 20 g/L, 30 g/L, or 40 g/L followed by addition of further substrate to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. This substrate supplementation reaction condition allows for higher substrate loadings to be achieved while maintaining high rates of conversion of substrate to hydroxylated product of at least about 50%, 60%, 70%, 80%, 90% or greater conversion of substrate. In some embodiments of this process, the substrate added is in a solution comprising α-ketoglutarate at an equimolar or higher amount of the further added substrate.

In some embodiments of the processes, the reaction using an engineered proline hydroxylase polypeptide can comprise the following suitable reaction conditions: (a) substrate loading at about 5 g/L to 30 g/L; (b) about 0.1 g/L to 10 g/L of the engineered polypeptide; (c) about 19 g/L (0.13 M) to 57 g/L (0.39 M) of α-ketoglutarate; (d) about 14 g/L (0.08 M) to 63 g/L (0.36 M) ascorbic acid; (e) about 1.5 g/L (3.8 mM) to 4.5 g/L (11.5 mM) of $FeSO_4$; (f) a pH of about 6 to 7; (g) temperature of about 20° to 40° C.; and (h) reaction time of 2-24 h.

In some embodiments of the processes, the reaction using an engineered proline hydroxylase polypeptide can comprise the following suitable reaction conditions: (a) substrate loading at about 10 g/L to 100 g/L; (b) about 1 g/L to about 50 g/L of engineered polypeptide; (c) α-ketoglutarate at about 1 to 2 molar equivalents of substrate compound; (d) ascorbic acid at about 0.25 to 0.75 molar equivalents of substrate compound; (e) about 0.5 mM to about 12 mM of $FeSO_4$; (f) pH of about 6 to 8; (g) temperature of about 20° to 40° C.; and (h) reaction time of 6 to 120 h.

In some embodiments, additional reaction components or additional techniques carried out to supplement the reaction conditions. These can include taking measures to stabilize or prevent inactivation of the enzyme, reduce product inhibition, shift reaction equilibrium to hydroxylated product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the hydroxylated product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); NA (nucleic acid; polynucleotide); AA (amino acid; polypeptide); E. coli W3110 (commonly used laboratory E. coli strain, available from the Coli Genetic Stock Center [CGSC], New Haven, Conn.); HPLC (high pressure liquid chromatography); SDS-PAGE (sodium dodecyl sulfate polyacrylamide gel electrophoresis); PES (polyethersulfone); CFSE (carboxyfluorescein succinimidyl ester); IPTG (isopropyl beta-D-1-thiogalactopyranoside); PMBS (polymyxin B sulfate); NADPH (nicotinamide adenine dinucleotide phosphate); GDH (glucose dehydrogenase); polyethylenimine (PEI); FIOPC (fold improvement over positive control); DO (dissolved oxygen); ESI (electrospray ionization); LB (Luria broth); TB (terrific broth); MeOH (methanol); HTP (high throughput); SFP (shake flask powder); DSP (downstream process powder); Athens Research (Athens Research Technology, Athens, Ga.); ProSpec (ProSpec Tany Technogene, East Brunswick, N.J.); Sigma-Aldrich (Sigma-Aldrich, St. Louis, Mo.); Ram Scientific (Ram Scientific, Inc., Yonkers, N.Y.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, AG, Basel, Switzerland); Cambridge Isotope Laboratories, (Cambridge Isotope Laboratories, Inc., Tewksbury, Mass.); Applied Biosystems (Applied Biosystems, part of Life Technologies, Corp., Grand Island, N.Y.), Agilent (Agilent Technologies, Inc., Santa Clara, Calif.); Thermo Scientific (part of Thermo Fisher Scientific, Waltham, Mass.); Fisher (Fisher Scientific, Waltham, Mass.); Corning (Corning, Inc., Palo Alto, Calif.); Waters (Waters Corp., Milford, Mass.); GE Healthcare (GE Healthcare Bio-Sciences, Piscataway, N.J.); Pierce (Pierce Biotechnology (now part of Thermo Fisher Scientific), Rockford, Ill.); Phenomenex (Phenomenex, Inc., Torrance, Calif.); Optimal (Optimal Biotech Group, Belmont, Calif.); and Bio-Rad (Bio-Rad Laboratories, Hercules, Calif.).

The following sequences were used in the development of the present invention.

pJV110900:

(SEQ ID NO: 1007)

```
tcgagttaattaaggcagtgagcgcaacgcaattaatgtgagttagctcactcattaggcaccccaggctttacactttatgcttccggctcgtatg
ttgtgtggaattgtgagcggataacaatttcacacaggaaacggctatgaccatgattacggattcactggccgtcgttttacaatctagaggccag
cctggccataaggagatatacatatgagtattcaacatttccgtgtcgcccttattcctttttttgcggcattttgccttcctgtttttgctcaccca
gaaacgctggtgaaagtaaaagatgctgaagatcagttgggtgcacgagtgggttacatcgaactggatctcaacagcggtaagatccttgagagtt
ttcgccccgaagagcgttttccaatgatgagcacttttaaagttctgctatgtggcgcggtattatcccgtgttgacgccgggcaagagcaactcgg
tcgccgcatacactattctcagaatgacttggttgagtactcaccagtcacagaaaagcatcttacggatggcatgacagtaagagaattatgcagt
gctgccataaccatgagtgataacactgcggccaacttacttctgacaacgatcggaggaccgaaggagctaaccgttttttttgcacaccatggggg
atcatgtaactcgccttgatcgttgggaaccggagctgaatgaagccataccaaacgacgagcgtgacaccacgatgcctacagcaatggcaacaac
gttgcgcaaactattaactggcgaactacttactctagcttcccggcaacaattaatagactggatggaggcggataaagttgcaggaccacttctg
cgctcggcccttccggctggctggtttattgctgataaatctggagccggtgagcgtgggtctcgcggtatcattgcagcactggggccagatggta
agccctcccgtatcgtagttatctacacgacggggagtcaggcaactatggatgaacgaaatagacagatcgctgagataggtgcctcactgattaa
gcattggggccaaactggccaccatcaccatcaccattagggaagagcagatgggcaagcttgacctgtgaatgaaaaatggcgcacattgtgcgac
atttttttttgaattctacgtaaaaagcagccgatacatcggctgcttttttttctgcagggtgaaacaaaacggttaacaacatgaagtaaacac
ggtacggtgaaataagatcactccggggcgtatttttgagttatcgagattttcaggagctaaggaagctaaatggagaaaaaaatcactggata
taccaccgttgatatatcccaatggcatcgtaaagaacattttgaggcatttcagtcagttgctcaatgtacctataaccagaccgttcagctggat
attacggccttttaaagaccgtaaagaaaaataagcacaagttttatccggcctttattcacattcttgcccgcctgatgaatgctcatccggagt
tccgtatggcaatgaaagacggtgagctggtgatatgggatagtgttcacccttgttacaccgttttccatgagcaaactgaaacgttttcatcgct
ctggagtgaataccacgacgatttccggcagtttctacacatatattcgcaagatgtggcgtgttacggtgaaacctggcctatttccctaaaggg
tttattgagaatatgttttcgtctcagccaatccctgggtgagtttcaccagttttgatttaaacgtggccaatatggacaacttcttcgccccg
ttttcaccatgggcaaatattatacgcaaggcgacaaggtgctgatgccgctggcgattcaggttcatcatgccgtctgtgatggcttccatgtcgg
cagaatgcttaatgaattacaacagtactgcgatgagtggcagggcggggcgtaactgcaggagctcaaacagcagcctgtattcaggctgcttttt
agaaatattttatctgattaataagatgatcttcttgagatcgttttggtctgcgcgtattctcttgctctgaaaacgaaaaaaccgccttgcaggg
cggttttcgaaggttctctgagctaccaactctttgaaccgaggtaactggcttggaggagcgcagtcaccaaaacttgtcctttcagtttagcct
```

-continued taaccggcgcatgacttcaagactaactcctctaaatcaattaccagtggctgctgccagtggtgcttttgcatgtctttccgggttggactcaaga
cgatagttaccggataaggcgcagcggtcggactgaacgggggttcgtgcatacagtccagcttggagcgaactgcctacccgaactgagtgtca
ggcgtggaatgagacaaacgcggccataacagcggaatgacaccggtaaaccgaaaggcaggaacaggagagcgcacgagggagccgccagggggaa
acgcctggtatctttatagtcctgtcgggtttcgccaccactgatttgagcgtcagatttcgtgatgcttgtcagggggcggagcctatgaaaaa
cggctttgccgcggccctctcacttccctgttaagtatcttcctggcatcttccaggaaatctccgccccgttcgtaagccatttccgctcgccgca
gtcgaacgaccgagcgtagcgagtcagtgagcgaggaagcggaatatatcctgtatcacatattctgctgacgcaccggtgcagccttttttctcct
gccacatgaagcacttcactgacaccctcatcagtgaaccaccgctggtagcggtggttttttttaggcctatggccttttttttttgtgggaaacct
ttcgcggtatggtattaaagcgcccgaagagagtcaattcagggtggtgaatgtgaaaccagtaacgttatacgatgtcgcagagtatgccggtgt
ctcttatcagaccgtttcccgcgtggtgaaccaggccagccacgtttctgcgaaaacgcgggaaaaagtggaagcggcgatggcggagctgaattac
attcccaaccgcgtggcacaacaactggcgggcaaacagtcgttgctgattggcgttgccacctccagtctggccctgcacgcgccgtcgcaaattg
tcgcggcgattaaatctcgcgccgatcaactgggtgccagcgtggtggtgtcgatggtagaacgaagcggcgtcgaagcctgtaaagcggcggtgca
caatcttctcgcgcaacgcgtcagtgggctgatcattaactatccgctggatgaccaggatgccattgctgtggaagctgcctgcactaatgttccg
gcgttatttcttgatgtctctgaccagacaccccatacaacagtattatttttctcccatgaagacggtacgcgactgggcgtggagcatctggtcgca
ttgggtcaccagcaaatcgcgctgttagcgggcccattaagttctgtctcggcgcgtctgcgtctggctggctggcataaatatctcactcgcaatc
aaattcagccgatagcggaacgggaaggcgactggagtgccatgtccggttttcaacaaaccatgcaaatgctgaatgagggcatcgtttccactgc
gatgctggttgccaacgatcagatggcgctgggcgcaatgcgcgccattaccgagtccgggctgcgcgttggtgcggacatctcggtagtgggatac
gacgataccgaagacagctcatgttatatcccgccgttaaccaccatcaaacaggattttcgcctgctggggcaaaccagcgtggaccgcttgctgc
aactctctcagggccaggcggttaagggcaatcagctgttgcccgtctcactggtgaaaagaaaaaccaccctggcgcccaatacgcaaaccgcctc
tccccgcgcgttggccgattcattaatgcagctggcacgacaggtttcccgactggaaagcgggcagtgagcggtacccgataaaagcggcttcctg
acaggaggccgtttttgtttc pJV110900 a18c RBS
(SEQ ID NO: 1008)

tcgagttaattaaggcagtgagcgcaacgcaattaatgtgagttagctcactcattaggcaccccaggctttacactttatgcttccggctcgtatg
ttgtgtggaattgtgagcggataacaatttcacacaggaaacggctatgaccatgattacggattcactggccgtcgttttacaatctagaggccag
cctggccataaggcgatatacatatgagtattcaacatttccgtgtcgcccttattccctttttttgcggcattttgccttcctgtttttgctcaccc
agaaacgctggtgaaagtaaaagatgctgaagatcagttgggtgcacgagtgggttacatcgaactggatctcaacagcggtaagatccttgagagt
tttcgccccgaagagcgttttccaatgatgagcacttttaaagttctgctatgtggcgcggtattatcccgtgttgacgccgggcaagagcaactcg
gtcgccgcatacactattctcagaatgacttggttgagtactcaccagtcacagaaaagcatcttacggatggcatgacagtaagagaattatgcag
tgctgccataaccatgagtgataacactgcggccaacttacttctgacaacgatcggaggaccgaaggagctaaccgttttttttgcacaccatgggg
gatcatgtaactcgccttgatcgttgggaaccggagctgaatgaagccataccaaacgacgagcgtgacaccacgatgcctacagcaatggcaacaa
cgttgcgcaaactattaactggcgaactacttactctagcttcccggcaacaattaatagactggatggaggcggataaagttgcaggaccacttct
gcgctcggcccttccggctggctggtttattgctgataaatctggagccggtgagcgtgggtctcgcggtatcattgcagcactggggccagatggt
aagccctcccgtatcgtagttatctacacgacggggagtcaggcaactatggatgaacgaaatagacagatcgctgagataggtgcctcactgatta
agcattgggccaaactggccaccatcaccatcaccattagggaagagcagatgggcaagcttgacctgtgaagtgaaaaatggcgcacattgtgcg
acattttttttgaattctacgtaaaaagcagccgatacatcggctgctttttttttctgcagggtgaaacaaaacggttaacaacatgaagtaaac
acggtacggtgaaataagatcactccggggcgtattttttgagttatcgagattttcaggagctaaggaagctaaaatggagaaaaaatcactgga
tataccaccgttgatatatcccaatggcatcgtaaagaacatttttgaggcatttcagtcagttgctcaatgtacctataaccagaccgttcagctgg
atattacggcctttttaaagaccgtaaagaaaataagcacaagttttatccggcctttattcacattcttgcccgcctgatgaatgctcatccgg
agttccgtatggcaatgaaagacggtgagctggtgatatgggatagtgttcacccttgttacaccgttttccatgagcaaactgaaacgttttcatc
gctctggagtgaataccacgacgatttccggcagtttctacacatatattcgcaagatgtggcgtgttacggtgaaaacctggcctatttccctaaa
gggtttattgagaatatgttttcgtctcagccaatccctgggtgagtttcaccagttttgatttaaacgtggccaatatggacaacttcttcgccc
ccgttttcaccatgggcaaatattatacgcaaggcgacaaggtgctgatgccgctggcgattcaggttcatcatgccgtctgtgatggcttccatgt -continued cggcagaatgcttaatgaattacaacagtactgcgatgagtggcagggcggggcgtaactgcaggagctcaaacagcagcctgtattcaggctgctt
tttagaaatattttatctgattaataagatgatcttcttgagatcgttttggtctgcgcgtattctcttgctctgaaaacgaaaaaaccgccttgca
gggcggttttttcgaaggttctctgagctaccaactctttgaaccgaggtaactggcttggaggagcgcagtcaccaaaacttgtcctttcagtttag
ccttaaccggcgcatgacttcaagactaactcctctaaatcaattaccagtggctgctgccagtggtgcttttgcatgtcttccggggttggactca
agacgatagttaccggataaggcgcagcggtcggactgaacgggggggttcgtgcatacagtccagcttggagcgaactgcctacccggaactgagtg
tcaggcgtggaatgagacaaacgcggccataacagcggaatgacaccggtaaaccgaaaggcaggaacaggagagcgcacgagggagccgccagggg
gaaacgcctggtatctttatagtcctgtcgggtttcgccaccactgatttgagcgtcagatttcgtgatgcttgtcaggggggcggagcctatggaa
aaacggctttgccgcggccctctcacttccctgttaagtatcttcctggcatcttccaggaaatctccgccccgttcgtaagccatttccgctcgcc
gcagtcgaacgaccgagcgtagcgagtcagtgagcgaggaagcggaatatatcctgtatcacatattctgctgacgcaccggtgcagcctttttttct
cctgccacatgaagcacttcactgacaccctcatcagtgaaccaccgctggtagcggtggttttttttaggcctatggccttttttttttgtgggaaa
cctttcgcggtatggtattaaagcgcccggaagagagtcaattcagggtggtgaatgtgaaaccagtaacgttatacgatgtcgcagagtatgccgg
tgtctcttatcagaccgtttcccgcgtggtgaaccaggccagccacgtttctgcgaaaacgcgggaaaaagtggaagcggcgatggcggagctgaat
tacattcccaaccgcgtggcacaacaactggcgggcaaacagtcgttgctgattggcgttgccacctccagtctggccctgcacgcgccgtcgcaaa
ttgtcgcggcgattaaatctcgcgccgatcaactgggtgccagcgtggtggtgtcgatggtagaacgaagcggcgtcgaagcctgtaaagcggcggt
gcacaatcttctcgcgcaacgcgtcagtgggctgatcattaactatccgctggatgaccaggatgccattgctgtggaagctgcctgcactaatgtt
ccggcgttatttcttgatgtctctgaccagacacccatcaacagtattattttctcccatgaagacggtacgcgactgggcgtggagcatctggtcg
cattgggtcaccagcaaatcgcgctgttagcgggcccattaagttctgtctcggcgcgtctgcgtctggctggctggcataaatatctcactcgcaa
tcaaattcagccgatagcggaacgggaaggcgactggagtgccatgtccggttttcaacaaaccatgcaaatgctgaatgagggcatcgtttccact
gcgatgctggttgccaacgatcagatggcgctgggcgcaatgcgcgccattaccgagtccgggctgcgcgttggtgcggacatctcggtagtgggat
acgacgataccgaagacagctcatgttatatcccgccgttaaccaccatcaaacaggattttcgcctgctggggcaaaccagcgtggaccgcttgct
gcaactctctcagggccaggcggttaagggcaatcagctgttgcccgtctcactggtgaaagaaaaaccacccctggcgcccaatacgcaaaccgcc
tctccccgcgcgttggccgattcattaatgcagctggcacgacaggtttcccgactggaaagcgggcagtgagcggtacccgataaaagcggcttcc
tgacaggaggccgttttgtttc pJV110900 gc RBS
(SEQ ID NO: 1009)

tcgagttaattaaggcagtgagcgcaacgcaattaatgtgagttagctcactcattaggcacccaggctttacactttatgcttccggctcgtatg
ttgtgtggaattgtgagcggataacaatttcacacaggaaacggctatgaccatgattacggattcactggccgtcgttttacaatctagaggcag
cctggccataagggcatatacatatgagtattcaacatttccgtgtcgcccttattcccttttttgcggcattttgccttcctgtttttgctcaccc
agaaacgctggtgaaagtaaaagatgctgaagatcagttgggtgcacgagtgggttacatcgaactggatctcaacagcggtaagatccttgagagt
tttcgccccgaagagcgttttccaatgatgagcacttttaaagttctgctatgtggcgcggtattatcccgtgttgacgccgggcaagagcaactcg
gtcgccgcatacactattctcagaatgacttggttgagtactcaccagtcacagaaaagcatcttacggatggcatgacagtaagagaattatgcag
tgctgccataaccatgagtgataacactgcggccaacttacttctgacaacgatcggaggaccgaaggagctaaccgcttttttgcacaccatgggg
gatcatgtaactcgccttgatcgttgggaaccggagctgaatgaagccataccaaacgacgagcgtgacaccacgatgcctacagcaatggcaacaa
cgttgcgcaaactattaactggcgaactacttactctagcttcccggcaacaattaatagactggatggaggcggataaagttgcaggaccacttct
gcgctcggcccttccggctggctggtttattgctgataaatctggagccggtgagcgtgggtctcgcggtatcattgcagcactggggccagatggt
aagccctcccgtatcgtagttatctacacgacggggagtcaggcaactatggatgaacgaaatagacagatcgctgagataggtgcctcactgatta
agcattggggccaactggccaccatcaccatcaccattaggaagagcagatgggcaagcttgacctgtgaagtgaaaaatggcgcacattgtgcg
acattttttttgaattctacgtaaaaagcagccgatacatcggctgctttttttctgcagggtgaaacaaaacggttaacaacatgaagtaaac
acggtacggtgaaataagatcactccggggcgtatttttgagttatcgagattttcaggagctaaggaagctaaaatgagaaaaaatcactgga
tataccaccgttgatatatcccaatggcatcgtaaagaacattttgaggcatttcagtcagttgctcaatgtacctataaccagaccgttcagctgg
atattacggcctttttaaagaccgtaaagaaaaataagcacaagttttatccggcctttattcacattcttgcccgcctgatgaatgctcatccgga
gttccgtatggcaatgaaagacggtgagctggtgatatgggatagtgttcacccttgttacaccgttttccatgagcaaactgaaacgttttcatc -continued

```
gctctggagtgaataccacgacgatttccggcagtttctacacatatattcgcaagatgtgcgtgttacggtgaaaacctggcctatttccctaaa gggtttattgagaatatgttttcgtctcagccaatccctgggtgagtttcaccagttttgatttaaacgtggccaatatggacaacttcttcgccc ccgttttcaccatgggcaaatattatacgcaaggcgacaaggtgctgatgccgctggcgattcaggttcatcatgccgtctgtgatggcttccatgt cggcagaatgcttaatgaattacaacagtactgcgatgagtggcagggcggggcgtaactgcaggagctcaaacagcagcctgtattcaggctgctt tttagaaatattttatctgattaataagatgatcttcttgagatcgttttggtctgcgcgtattctcttgctctgaaaacgaaaaaaccgccttgca gggcggttttcgaaggttctctgagctaccaactctttgaaccgaggtaactggcttggaggagcgcagtcaccaaaacttgtcctttcagtttag ccttaaccggcgcatgacttcaagactaactcctctaaatcaattaccagtggctgctgccagtggtgcttttgcatgtctttccgggttggactca agacgatagttaccggataaggcgcagcggtcggactgaacggggggttcgtgcatacagtccagcttggagcgaactgcctacccggaactgagtg tcaggcgtggaatgagacaaacgcggccataacagcggaatgacaccggtaaaccgaaaggcaggaacaggagagcgcacgagggagccgccagggg gaaacgcctggtatctttatagtcctgtcgggtttcgccaccactgatttgagcgtcagatttcgtgatgcttgtcaggggggcggagcctatggaa aaacggctttgccgcggccctctcacttccctgttaagtatcttcctggcatcttccaggaaatctccgcccgttcgtaagccatttccgctcgcc gcagtcgaacgaccgagcgtagcgagtcagtgagcgaggaagcggaatatatcctgtatcacatattctgctgacgcaccggtgcagccttttttct cctgccacatgaagcacttcactgacaccctcatcagtgaaccaccgctggtagcggtggttttttaggcctatggccttttttttttgtgggaaa cctttcgcggtatggtattaaagcgcccgaagagagtcaattcagggtggtgaatggaaaccagtaacgttatacgatgtcgcagagtatgccggt gtctcttatcagaccgtttcccgcgtggtgaaccaggccagccacgtttctgcgaaaacgcgggaaaaagtggaagcggcgatggcggagctgaatt acattcccaaccgcgtggcacaacaactggcgggcaaacagtcgttgctgattggcgttgccacctccagtctggccctgcacgcgccgtcgcaaat tgtcgcggcgattaaatctgcgccgatcaactgggtgccagcgtggtggtgtcgatggtagaacgaagcggcgtcgaagcctgtaaagcggcggtgc acaatcttctcgcgcaacgcgtcagtgggctgatcattaactatccgctggatgaccaggatgccattgctgtggaagctgcctgcactaatgttcc ggcgttatttcttgatgtctctgaccagacacccatcaacagtattattttctcccatgaagacggtacgcgactgggcgtggagcatctggtcgca ttgggtcaccagcaaatcgcgctgttagcgggcccattaagttctgtctcggcgcgtctgcgtctggctggctggcataaatatctcactcgcaatc aaattcagccgatagcggaacgggaaggcgactggagtgccatgtccggttttcaacaaaccatgcaaatgctgaatgagggcatcgtttccactgc gatgctggttgccaacgatcagatggcgctgggcgcaatgcgcgccattaccgagtccgggctgcgcgttggtgcggacatctcggtagtgggatac gacgataccgaagacagctcatgttatatcccgccgttaaccaccatcaaacaggattttcgcctgctggggcaaaccagcgtggaccgcttgctgc aactctctcagggccaggcggttaagggcaatcagctgttgcccgtctcactggtgaaaagaaaaaccaccctggcgcccaatacgcaaaccgcctc tccccgcgcgttggccgattcattaatgcagctggcacgacaggtttcccgactggaaagcgggcagtgagcggtacccgataaaagcggcttcctg acaggaggccgttttgtttc
```

Example 1

Expression and Screening Engineered Proline Hydroxylase Polypeptides

The polynucleotide sequence SEQ ID NO:4 (See, SEQ ID NO:134 of WO2013/169725A2) was cloned into a pCK110900 vector system (See e.g., US Pat. Appln. Publn. 2006/0195947, which is hereby incorporated by reference herein), pJV110900 vector system (SEQ ID NO:1007), pJV110900 a18c RBS vector system (SEQ ID NO:1008) or pJV110900 gc RBS vector system (SEQ ID NO:1009) and subsequently expressed in the E. coli W3110 strain. The E. coli W3110 strain expresses the proline hydroxylase polypeptides under the control of the lac promoter. Based on sequence comparisons with other proline hydroxylases and computer modeling of the enzyme structure docked to the substrate proline, residue positions associated with the active site, peptide loops, solution/substrate interface, and potential stability positions were identified and subjected to mutagenesis. These first round variants were screened under HTP Assay conditions with (2S)-piperidine-2-carboxylic acid as substrate. Variants with increased enzymatic activity and/or expression were identified. The residue differences from the first round screening were combined in various permutations and screened for improved properties under HTP Assay, SFP Assay, and DSP Assay conditions. The engineered proline hydroxylase polypeptide sequences and specific mutations and relative activities obtained from the screens are listed in the Tables in the following Examples.

Example 2

Production of Engineered Proline Hydroxylases

As indicated above, the engineered proline hydroxylase polypeptides of Example 1 were produced in E. coli W3110 under the control of the lac promoter. Enzyme preparations for HTP, DSP, and SFP assays were made as follows.

High-Throughput (HTP) Growth, Expression, and Lysate Preparation

Cells were picked and grown overnight in LB media containing 1% glucose and 30 μg/mL chloramphenicol (CAM), 30° C., 200 rpm, 85% humidity. A 20 μL aliquot of overnight growth was transferred to a deep well plate containing 380 μL 2×TB growth media containing 30 μg/mL CAM, 1 mM IPTG, and incubated for ~18 h at 30° C., 200 rpm, 85% humidity. Cell cultures were centrifuged at 4000 rpm, 4° C. for 10 min., and the media discarded. Cell pellets were resuspended in 200 μL lysis buffer (50 mM Bis-Tris buffer, pH 6.3, containing, 0.5 mg/mL PMBS, 1 mM MgSO$_4$ and 1 mg/mL lysozyme). Lysis buffer was prepared fresh by adding to 90 mL of 50 mM Bis-Tris buffer, pH 6.3, 10 mL of 10 mM MgSO$_4$ in Bis-Tris, pH 6.3, 50 mg of PMBS and 100 mg of lysozyme.

Production of Shake Flask Powders (SFP)

A shake-flask procedure was used to generate engineered proline hydroxylase polypeptide powders used in secondary screening assays or in the biocatalytic processes disclosed herein. Shake flask powders provided a more purified preparation (e.g., up to 30% of total protein) of the engineered enzyme as compared to the cell lysate used in HTP assays. A single colony of E. coli containing a plasmid encoding an engineered polypeptide of interest was inoculated into 50 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7, 1 mM MgSO$_4$) containing 30 μg/ml chloramphenicol, in a 1 liter flask to an optical density of 600 nm (OD600) of 0.05 and allowed to grow at 30° C. Expression of the proline hydroxylase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cell pellet was resuspended with an equal volume of cold (4° C.) 25 mM Tris-HCl buffer, pH 6.3, and harvested by centrifugation, as described above. The washed cells were resuspended in two volumes of the cold 25 mM Tris-HCl buffer, pH 6.3, and passed twice through a French Press at 12,000 psi while being maintained at 4° C. Cell debris was removed by centrifugation (9000 rpm, 45 minutes, 4° C.). The clear lysate supernatant was collected and stored at −20° C. Lyophilization of frozen clear lysate provided a dry shake-flask powder of crude engineered polypeptide. Alternatively, the cell pellet (before or after washing) can be stored at 4° C. or −80° C.

Production of Downstream Process Powders (DSP)

DSP powders provided a more purified preparation of the engineered proline hydroxylase enzyme as compared to the cell lysate used in the HTP or SFP assays. Larger-scale fermentation of the engineered proline hydroxylase for production of DSP powders (~100-120 g from 10 L) can be carried out as a short batch followed by a fed batch process according to standard bioprocess methods. Briefly, proline hydroxylase expression was induced by addition of IPTG to a final concentration of 1 mM. Following fermentation, the cells were harvested and resuspended in 33 mM TEA buffer, then mechanically disrupted by homogenization. The cell debris and nucleic acid were flocculated with PEI and the suspension clarified by centrifugation. The resulting clear supernatant was concentrated using a tangential cross-flow ultrafiltration membrane to remove salts and water. The concentrated and partially purified enzyme concentrate can then be dried in a lyophilizer and packaged (e.g., in polyethylene containers).

Example 3

Analytical Procedures

In this Example, the analytical procedures used to characterize the enzyme variants provided herein are described.

Method 1—HPLC Analysis of HTP Assay, SFP and DSP Reactions:

In a 96 deep well format assay block, 5 uL of reaction solution was diluted with 200 uL of 5% sodium bicarbonate solution followed by 200 uL of dansyl chloride solution (10 mg/mL dansyl chloride in MeCN). The plate was heat sealed, centrifuged, and placed in an incubator with shaking at 600 rpm at 44-45° C. for 1 hour. The reaction solution turns from yellow to light yellow when derivatization with dansyl chloride is complete. In cases where the solution remained yellow, the plate was heated for another 15 min. After incubation, the plate was centrifuged for 1 min at 4000 rpm. A 20 uL aliquot of supernatant was transferred into a 96 Corning plate containing 140 ul of water per well for HPLC analysis. The quenched reaction was subject to HPLC analysis under the following conditions.

TABLE 3.1

Method 1 HPLC Equipment and Reaction Conditions

| Column | Ascentis Express C18 (2.7 um) 4.6 × 100 mM |
| --- | --- |
| Temperature | 25° C. |
| Mobile Phase | Solvent A: 10 mM NH$_4$OAc pH 4.0 |
| | Solvent B: Acetonitrile\Mobile Phase Profile |

| Time: min | % A | % B | Flow rate: mL/min |
| --- | --- | --- | --- |
| 0.00 | 75 | 25 | 1.5 |
| 4.00 | 35 | 65 | 1.5 |
| 4.1 | 0 | 100 | 1.5 |
| 5.5 | 0 | 100 | 1.5 |

| | |
| --- | --- |
| Postime | 1.00 minutes/sample |
| Detection Wavelength | 250 nm |
| Column Temperature | 40° C. |
| Injection Volume | 25 uL |
| Total Runtime | 5.5 minutes/sample |
| Response Factor (Substrate Area/Product Area) | 1 |

Conversion of compound (1) to compound (2) was determined from the resulting chromatograms as follows:

% Conversion={(RF×Product Area)/[(RF×Product Area)+Substrate Area]}×100 where

Response Factor (RF)=Substrate Area/Product Area.

This method was used for rapid identification for conversion of (2S)-piperidine-2-carboxylic acid (compound 1) to hydroxypiperidine-2-carboxylic acid (compound 2). The chromatographic elution profiles, denoted as "Response time" are provided in Table 3.2.

TABLE 3.2

Compounds and Response Times

| Compound | Structure | Response Time |
| --- | --- | --- |
| (2S,5R)-1-(5-(dimethylamino)naphthalene-1-ylsulfonyl)-5-hydroxypiperidine-2-carboxylic acid | | 2.2 min |
| (2S,5S)-1-(5-(dimethylamino)naphthalene-1-ylsulfonyl)-5-hydroxypiperidine-2-carboxylic acid | | 2.4 min |

TABLE 3.2-continued

Compounds and Response Times

| Compound | Structure | Response Time |
|---|---|---|
| (2S,3S)-1-(5-(dimethylamino)naphthalene-1-ylsulfonyl)-3-hydroxypiperidine-2-carboxylic acid | | 2.6 min |
| (2S,4R)-1-(5-(dimethylamino)naphthalene-1-ylsulfonyl)-3-hydroxypiperidine-2-carboxylic acid | | 2.8 min |
| Dansyl-NH2 | | 2.9 min |
| (S)-1-(5-(dimethylamino)naphthalene-1-ylsulfonyl)piperidine-2-carboxylic acid | | 3.9 min |

Method 2—LC/MS/MS Analysis of HTP Assay

The reactions were quenched by diluting 2000-fold in 50:50 acetonitrile:H$_2$O, and the reaction products analyzed by LC/MS/MS. LC/MS/MS analysis for hydroxypipecolic acid and pipecolic acid was carried out under the following conditions:

TABLE 3.3

Method 2 HPLC Equipment and Reaction Conditions

| | |
|---|---|
| Column | ChiroBiotic TAG 100 × 4.6 mm, 5 µm |
| Mobile Phase | Solution A: 0.1% formic acid |
| | Solution B: 0.1% formic acid in acetonitrile |
| | A:B = 50:50 |
| | 0.5 mL/min |

TABLE 3.3-continued

Method 2 HPLC Equipment and Reaction Conditions

| | |
|---|---|
| Postime | 5.0 min |
| MS conditions | Source dependent parameters: CUR 30, IS 5500, TEM 590° C., GS1 60, GS2 60, DP30, EP10, CE 20 MRM: 130/84 (pipecolic acid RT 3.5 min), 146/100 (hydroxylated pipecolic acid 2.9 min) |
| Column Temperature | Not controlled |
| Injection Volume | 2 uL |

Method 3—Size Exclusion Chromatography (SEC) Method for Proline Hydroxylase Quantification In a 96 round-bottom well format assay block, 10 uL of proline hydroxylase lysate (or SF or DSP powder solution at 1 mg/mL powder solutions) reaction solution was diluted with 90 uL of water. The plate was heat sealed and samples injected onto the HPLC to quantify proline hydroxylase The samples were subject to HPLC analysis under the following conditions

TABLE 3.4

Method 3 HPLC Equipment and Reaction Conditions

| | | | | |
|---|---|---|---|---|
| Column | Phenomenex BioSep SEC-s2000 (3 um) 300 × 7.8 mM | | | |
| Temperature | 25° C. | | | |
| Mobile Phase | Solvent A: 25 mM Tris-HCl pH 7.0; 0.13M NaCl; 0.1% Azide | | | |
| | Time: min | % A | % B | Flow rate: mL/min |
| | 0.00-9 min | 100 | 0 | 1 |
| Postime | Set to "Off" | | | |
| Detection Wavelength | 214 and 225 nm | | | |
| Column Temperature | 25° C. | | | |
| Injection Volume | 10 ul | | | |
| Total Runtime | 9 minutes/sample | | | |
| Response Time (proline hydroxylase) | 8 min | | | |
| Response Time (lysozyme - present only in HTP lysates) | 11 min (elutes in subsequent run) | | | |

Method 4—HPLC Analysis of "One-Pot" Reactions from L-Lysine:

In a 96 deep well format assay block, 5 uL of reaction solution was diluted with 200 uL of 5% sodium bicarbonate solution followed by 200 uL of dansyl chloride solution (10 mg/mL dansyl chloride in MeCN). The plate was heat sealed, centrifuged, and placed in an incubator with shaking at 600 rpm at 44-45° C. for 1 hour. The reaction solution turns from yellow to light yellow when derivatization with dansyl chloride is complete. In cases where the solution remained yellow, the plate was heated for another 15 min. After incubation, the plate was centrifuged for 1 min at 4000 rpm. A 20 µL aliquot of supernatant was transferred into a 96 Corning plate containing 140 ul of water per well for HPLC analysis. The quenched reaction was subject to HPLC analysis under the following conditions.

TABLE 3.5

Method 4 HPLC Equipment and Reaction Conditions

| Column | Ascentis Express C18 (2.7 um) 4.6 × 100 mM |
| --- | --- |
| Temperature | 25° C. |
| Mobile Phase | Solvent A: 10 mM NaOAc/AcOH pH 4.0 |
| | Solvent B: water |

| Time: min | % A | % B | Flow rate: mL/min |
| --- | --- | --- | --- |
| 0.00 | 75 | 25 | 1.5 |
| 5.00 | 25 | 75 | 1.5 |
| 5.1 | 0 | 100 | 1.5 |
| 6.5 | 0 | 100 | 1.5 |

| Postime | 1.00 minutes/sample |
| --- | --- |
| Detection Wavelength | 250 nm |
| Column Temperature | 40° C. |
| Injection Volume | 25 uL |
| Total Runtime | 6.5 minutes/sample |
| Response Factor (Substrate Area/Product Area) | 1 |

Conversion of compound (1) to compound (2) was determined from the resulting chromatograms as follows:

% Conversion={(RF×Product Area)/[(RF×Product Area)+Substrate Area]}×100 where

Response Factor (RF)=Substrate Area/Product Area.

This method was used for rapid identification for conversion of L-lysine to hydroxypiperidine-2-carboxylic acid. The chromatographic elution profiles, denoted as "Response time" are provided in Table 3.6.

TABLE 3.6

| Compound | Structure | Response Time |
| --- | --- | --- |
| (2S,5S)-1-(5-(dimethyl-amino)naphthalene-1-ylsulfonyl)-5-hydroxypiperidine-2-carboxylic acid | | 2.3 min |
| (2S,3S)-1-(5-(dimethyl-amino)naphthalene-1-ylsulfonyl)-3-hydroxypiperidine-2-carboxylic acid | 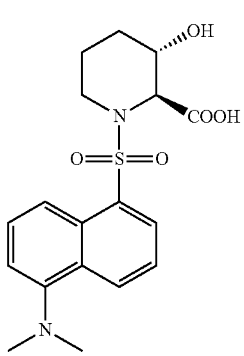 [SMILES: CN(C)c1cccc2c(S(=O)(=O)N3CCC[C@H](O)[C@H]3C(=O)O)cccc12] | 2.4 min |

TABLE 3.6-continued

| Compound | Structure | Response Time |
| --- | --- | --- |
| Dansyl-NH2 | 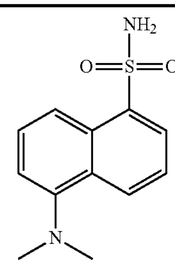 | 2.9 min |
| (5)-1-(5-(dimethyl-amino)naphthalene-1-ylsulfonyl)piperidine-2-carboxylic acid | | 3.6 min |
| L-lysine | 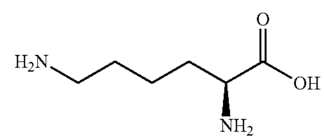 | 4.3 min |

Example 4

High Throughput (HTP) Screening of Proline Hydroxylases for Conversion of Compound (1) to Compound (2)

In this Example, the assay methods used for HTP screening of the proline hydroxylases of the present invention are described.

HTP Screening Assays:

High-throughput screening used to guide primary selection of variants was carried out in 96-well plates using cell lysates. Eight conditions, designated as "Condition" A, B, C, D, E, F, G and H were used. Cell growth and lysis for all eight conditions was carried out as follows. Cells were grown in 96-well plates as described above and lysates prepared by dispensing 200 uL lysis buffer into each well. Lysis buffer was prepared by dissolving 100 mg of lysozyme and 50 mg of PMBS in 90 mL of 50 mM Bis-Tris buffer, pH 6.3 and 10 mL of 10 mM MgSO4 in Bis-Tris, pH=6.3. The plate was heat sealed and then shaken for 2 h at room temperature. Subsequently, the plate was quick-spun to settle the lysate at the bottom of the plate. This crude lysate was used for the reactions.

Conditions A-E:

The final reaction parameters for Conditions A-E were as follows: 100 μL of 60 g/L pipecolic acid, 90 μL of 100 g/L α-ketoglutaric acid, 80 μL of lysate (Conditions A and B), 15 μL lysate (Conditions C-E), 65 μL of 50 mM Bis-Tris buffer pH=6.3 (Conditions C-E) and 30 μL of 40 mM (Condition A), 5 mM (Conditions B-E) Mohr's salt in 20 mM (Conditions A), 5 mM (Condition B) 100 mM (Conditions C-E) ascorbic acid. All stock solutions were buffered in 50 mM Bis-Tris, pH 6.3 and pH adjusted. 60 g/L Pipecolic acid solution and 100 g/L α-ketoglutaric acid solutions were purged under nitrogen for 20 minutes. 100 mM ascorbic acid solutions was prepared in 50 mM Bis-Tris, pH=6.3 buffer and pH adjusted with 50% NaOH to pH=6.3. The 100 mM ascorbic acid solution was purged under nitrogen for 20 minutes.

The Condition A-E reactions conducted at 300 μL scale were carried out in 96 well plates. In this assay, 100 μL per well of 60 g/L pipecolic acid in 50 mM Bis-Tris, pH=6.3 were aliquoted into a 96 well plate. To each well with 100 uL of 60 g/L pipecolic acid, 90 μL of 100 g/L α-ketoglutaric acid in 50 mM Bis-Tris, pH 6.3 was added, followed by 80 μL of crude cell lysate (Conditions A and B) or 154 crude cell lysate (Conditions C-E) and 65 μL of 50 mM Bis-Tris buffer pH=6.3 (Conditions C-E). The following premix stock solutions were prepared 40 mM (Condition A), 5 mM (Conditions B-E) Mohr's salt in 20 mM (Condition A), 5 mM (Condition B) and 100 mM (Conditions C-E) ascorbic acid in 50 mM Bis-Tris, pH 6.3 and 30 μL added into each well of the 96 well plate. The plate was sealed with an AirPore seal (Qiagen) and the reaction left to proceed overnight in a 2" throw Kuhner at 25° C., 200 rpm, 85% relative humidity.

Following the overnight incubation, 5 μL of the reaction from each well of the plate were diluted and subjected to LC/MS/MS analysis (Conditions A-B) or derivatized and quenched by aliquoting 5 ul of the reaction mix into a 96 deep well plate containing 200 ul/well of 5% sodium bicarbonate (Conditions C-E).

A 200 uL volume of 10 mg/mL of dansyl chloride in MeCN was added to each well, the plate heat sealed, and then quickly spun to settle the reaction solution to the bottom of the well. The plate was then heated at 44-45° C. for 1 hour with 600 rpm shaking. After incubation, the plate was centrifuged for 1 min at 4000 rpm. A 20 uL aliquot of supernatant was transferred into a 96-well Corning plate containing 140 ul of water per well for HPLC analysis.

Conditions F and G:

The final reaction parameters for Conditions F and G were as follows: 50 (Condition G) or 65 (Condition F) μL of 50 mM Bis-Tris, pH=6.3, 100 μL of 60 g/L pipecolic acid, 90 μL of 100 g/L α-ketoglutaric acid, 15 μL of crude cell lysate (Condition F), 30 μL crude cell lysate (Condition G), and 30 μL of 5 mM Mohr's salt in 100 mM ascorbic acid. All stock solutions were buffered in 50 mM Bis-Tris, pH 6.3 and pH adjusted. Then, 60 g/L pipecolic acid solution and 100 g/L α-ketoglutaric acid solutions were purged under nitrogen for 20 minutes. 100 mM ascorbic acid solutions was prepared in 50 mM Bis-Tris, pH=6.3 buffer and pH adjusted with 50% NaOH to pH=6.3. The 100 mM ascorbic acid solution was purged under nitrogen for 20 minutes.

The Conditions F and G reactions run at 300 μL scale were carried out in 96 well plates. 50 μL (Condition G) or 65 μL (Condition F) of 50 mM Bis-Tris buffer, pH=6.3 were aliquoted into each well of the 96 well plate, followed by addition of 90 μL of 100 g/L α-ketoglutaric acid in 50 mM Bis-Tris, pH 6.3 and 15 uL of crude cell lysate (Condition F) or 30 uL crude cell lysate (Condition G). A premix stock solutions of 5 mM Mohr's salt in 100 mM ascorbic acid in 50 mM Bis-Tris, pH 6.3 was made and 304 added into each well of the 96 well plate. The plate was sealed with an AirPore seal (Qiagen) and the reaction left to pre-incubate for 2 hours in a 2" throw Kuhner at 25° C., 200 rpm, 85% relative humidity. Following the pre-incubation 100 μL per well of 60 g/L pipecolic acid in 50 mM Bis-Tris, pH=6.3 was added. The plate was re-sealed with an AirPore seal (Qiagen) and the reaction left to pre-incubate for overnight in a 2" throw Kuhner at 25° C., 200 rpm, 85% relative humidity.

Following the overnight incubation, 5 uL of the reaction from each well was derivatized and quenched by aliquoting 5 ul of the reaction mix into a 96 deep well plate containing 200 ul/well of 5% sodium bicarbonate. A 200 uL volume of 10 mg/mL of dansyl chloride in MeCN was added to each well, the plate heat sealed, and then quickly spun to settle the reaction solution to the bottom of the well. The plate was then heated at 44-45° C. for 1 hour with 600 rpm shaking. After incubation, the plate was centrifuged for 1 min at 4000 rpm. A 20 uL aliquot of supernatant was transferred into a 96-well Corning plate containing 140 ul of water per well for HPLC analysis.

Condition H:

The final reaction parameters for Condition H were as follows: 100 μL of 180 g/L pipecolic acid, 90 μL of 300 g/L α-ketoglutaric acid, 30 μL of lysate, 50 μL of 50 mM Bis-Tris buffer pH=6.3 and 304 of 15 mM Mohr's salt in 300 mM ascorbic acid. All stock solutions were buffered in 50 mM Bis-Tris, pH 6.3 and pH adjusted.

First, 180 g/L Pipecolic acid solution and 300 g/L α-ketoglutaric acid solutions were purged under nitrogen for 20 minutes. Then, 300 mM ascorbic acid solutions were prepared in 50 mM Bis-Tris, pH=6.3 buffer and pH adjusted with 50% NaOH to pH=6.3. The 300 mM ascorbic acid solution was purged under nitrogen for 20 minutes.

The Condition H reactions run at 300 uL scale were carried out in 96 well plates. 100 uL per well of 180 g/L pipecolic acid in 50 mM Bis-Tris, pH=6.3 were aliquoted into a 96 well plate. To each well with 100 uL of 180 g/L pipecolic acid, 90 uL of 300 g/L α-ketoglutaric acid in 50 mM Bis-Tris, pH 6.3 was added, followed by 30 uL of crude cell lysate and 50 uL of 50 mM Bis-Tris buffer pH=6.3. The following premix stock solutions were prepared 15 mM Mohr's salt in 300 mM ascorbic acid in 50 mM Bis-Tris, pH 6.3 and 30 uL added into each well of the 96 well plate. The plate was sealed with an AirPore seal (Qiagen) and the reaction left to proceed overnight in a 2" throw Kuhner at 25° C., 200 rpm, 85% relative humidity.

Following the overnight incubation, 5 uL of the reaction from each well was derivatized and quenched by aliquoting 5 uL of the reaction mix into a 96 deep well plate containing 200 ul/well of 5% sodium bicarbonate. A 200 uL volume of 10 mg/mL of dansyl chloride in MeCN was added to each well, the plate heat sealed, and then quickly spun to settle the reaction solution to the bottom of the well. The plate was then heated at 44-45° C. for 1 hour with 600 rpm shaking. After incubation, the plate was centrifuged for 1 min at 4000 rpm. A 20 uL aliquot of supernatant was transferred into a 96-well plate containing 140 ul of water per well for HPLC analysis.

Each condition (A-H) is summarized below, along with the activity results. The activity levels (FIOPC) are indicated by "+" signs, according to the following key:

| Key for Tables 4.1-4.8 | |
| --- | --- |
| Indicator | FIOPC |
| − | −0.7 |
| + | 1-4 |
| ++ | 4-8 |

HTP Assay Condition A Summary and Results:

Cells grown in 96 well plates were lysed with 200 uL lysis buffer (1 mg/mL lysozyme, 0.5 mg/mL polymyxin B sulfate (PMBS) and 50 mM BisTris buffer, pH=6.3

The reaction conditions for a 300 uL reaction comprised: 20 g/L substrate compound (2), 30 g/L α-ketoglutaric acid; 0.35 g/L L-ascorbic acid; 4 mM Mohr's salt; 50 mM Bis-Tris buffer pH=6.3, 80 uL crude lysate and reaction temperature at about 25° C. (room temperature) for about 24 hours.

Plates were sealed with an O₂ permeable seal and incubated in a 2" throw Kuhner at 200 rpm and 85% relative humidity. The activity was measured relative to SEQ ID NO:4, calculated as the % conversion of the product formed per % conversion of the corresponding SEQ ID NO:4 (SEQ ID NO:134 of WO2013/169725A2) under the specified reaction conditions. The percent conversion was quantified by dividing the area of the product peak by the sum of the areas of the substrate, product and impurities/side product peaks as determined by LC/MS/MS analysis.

TABLE 4.1

| Sequence Information For Tested Variants and Results for Condition A | | |
|---|---|---|
| Variant No. | Amino Acid Differences (Relative to SEQ ID NO: 4) | Activity FIOPC |
| 6 | F176V | + |
| 8 | C37I | + |
| 10 | K39R | + |
| 12 | A156V | + |
| 14 | N131H | + |
| 16 | A101G | + |
| 18 | A36T/V97I | + |
| 20 | C43A/F176V | + |
| 22 | R88V/F176V | + |
| 24 | V44M/F176V | + |
| 26 | M151Q/F176V | + |
| 28 | E114R/F176V | + |
| 30 | L165Y/F176V | + |
| 32 | G128T/F176V | + |
| 34 | M151T/F176V | + |
| 36 | M151N/F176V | + |
| 38 | E115P/F176V | + |
| 40 | M151G/F176V | + |
| 42 | A173R/F176V | + |
| 44 | M151K/F176V | + |
| 46 | M151R/F176V | + |
| 48 | E114K/F176V | + |
| 50 | F176V/G270K | + |
| 52 | F176V/V194I | + |
| 54 | F176V/D237A | + |
| 56 | F176V/R274P | + |
| 58 | F176V/R274Q | + |
| 60 | F176V/R274E | + |
| 62 | F176V/D237S | + |
| 64 | F176V/D237T | + |
| 66 | F176V/D237K | + |
| 68 | F176V/G270R | + |
| 70 | F176V/D237C | + |
| 72 | F176V/E273V | + |
| 74 | F176V/R274L | + |
| 76 | F176V/R274A | + |
| 78 | C37L/A130F/Q166M/F176V | + |
| 80 | C37L/A130F/T132S/Q166M/F176V | + |
| 82 | C37L/Q166M/F176V | + |
| 84 | C37L/F176V | + |
| 86 | C37L/L42S/D124C/A130F/Q166M/F176V | + |
| 88 | C37L/T132S/Q166M/F176V | + |
| 90 | C37L/D124N/T132S/Q166M/F176V | + |
| 92 | S2F/M151R/F176V | + |
| 94 | G50S/M151R/F176V | + |
| 96 | S2I/M151R/F176V | + |
| 98 | S2E/M151R/F176V | + |
| 100 | I56R/M151R/F176V | + |
| 102 | S2N/M151R/F176V | + |
| 104 | K10N/M151R/F176V | + |
| 106 | R15C/M151R/F176V | + |
| 108 | G50A/M151R/F176V | + |
| 110 | K8Q/S87F/M151R/F176V | + |
| 112 | K71C/M151R/F176V | + |
| 114 | L76F/M151R/F176V | + |
| 116 | S87V/M151R/F176V | + |
| 118 | S87F/M151R/F176V | + |
| 120 | P63L/M151R/F176V | + |
| 122 | S87C/M151R/F176V | + |
| 124 | S87Y/M151R/F176V | + |
| 126 | S87P/M151R/F176V | + |
| 128 | S87L/M151R/F176V | + |
| 130 | P63I/M151R/F176V | + |
| 132 | N77Y/M151R/F176V | + |
| 134 | L76V/M151R/F176V | + |
| 136 | P63F/M151R/F176V | + |
| 138 | S87W/M151R/F176V | + |
| 140 | E81C/M151R/F176V | + |

TABLE 4.1-continued

Sequence Information For Tested Variants and Results for Condition A

| Variant No. | Amino Acid Differences (Relative to SEQ ID NO: 4) | Activity FIOPC |
|---|---|---|
| 142 | A62C/M151R/F176V | + |
| 144 | P63H/M151R/F176V | + |
| 146 | P63V/M151R/F176V | + |
| 148 | S2H/M151R/F176V | + |
| 150 | V57I/M151R/F176V | + |
| 152 | E81L/M151R/F176V | + |
| 154 | K71V/M151R/F176V | + |
| 156 | A62F/M151R/F176V | + |
| 158 | K71I/M151R/F176V | + |
| 160 | V58M/M151R/F176V | + |
| 162 | C43A/E114K/M151G/F176V | + |
| 164 | C43A/E114H/M151H/L165Y/F176V | + |
| 166 | C43A/E115P/M151G/L165Y/A173R/F176V/D237C | + |
| 168 | C43A/E114K/G128T/M151G/F176V/D237T/G270R | + |
| 170 | C43A/G128T/M151G/F176V/D237A | + |
| 172 | C43A/M151Q/F176V/D237C | + |
| 174 | C43A/M151R/L165Y/F176V/D237K/G270R | + |
| 176 | C43A/E114K/M151Q/L165Y/F176V/D237A/E273V | + |
| 178 | C43A/M151R/L165Y/F176V/E273V | + |
| 180 | C43A/G128A/M151G/L165Y/F176V/E273V | + |
| 182 | C43A/M151Q/A173R/F176V/D237C/G270R | + |
| 184 | C43A/G128A/M151Q/A173R/F176V/D237S/E273V | + |
| 186 | M151G/A173R/F176V/G270R/E273V | + |
| 188 | C43A/G128T/M151G/L165Y/F176V/E273V | + |
| 190 | C43A/M151G/L165Y/F176V/E273V | + |
| 192 | G128T/M151R/L165Y/F176V/D237K/G270R | + |
| 194 | C43A/M151R/L165Y/F176V/D237K | + |
| 196 | C43A/E115P/L121M/M151Q/L165Y/F176V/E273V | + |
| 198 | C43A/E114K/M151Q/F176V/D237K/G270R | + |
| 200 | C43A/G128T/M151G/L165Y/A173R/F176V/D237C/G270R | + |
| 202 | C43A/M151Q/A173R/F176V/D237S/G270R/E273V | + |
| 204 | C43A/G128A/M151G/A173R/F176V/D237S/G270R | + |
| 206 | E114R/M151Q/F176V/G270R/E273V | + |
| 208 | C43A/E114R/E115P/M151R/F176V/E273V | + |
| 210 | C43A/E114K/M151G/L165Y/A173R/F176V/D237K/E273V | + |
| 212 | C43A/M151G/F176V/G270R/E273V | + |
| 214 | C43A/M151Q/F176V/D237A/E273V | + |
| 216 | C43A/E115P/G128T/M151G/A173R/F176V/E273V | + |
| 218 | M151G/L165Y/F176V/E273V | + |
| 220 | M151Q/A173R/F176V/D237S/G270R/E273V | + |
| 222 | C43A/M151R/F176V/E273V | + |
| 224 | C43A/G128T/M151F/F176V/D237C/E273V | + |
| 226 | C43A/E114K/M151R/A173R/F176V/D237S/G270R | + |
| 228 | C43A/E115P/G128T/M151G/F176V/E273V | + |
| 230 | C43A/G128T/M151G/A173R/F176V/D237T/G270R | + |
| 232 | C43A/M151Q/F176V/G270R | + |
| 234 | C43A/G128T/M151Q/F176V/D237S/G270R | + |
| 236 | C43A/M151R/F176V/D237A/E273V | + |
| 238 | E115Q/G128T/M151R/A173R/F176V | + |
| 240 | C43A/G128T/M151R/L165Y/F176V/E273V | + |
| 242 | C43A/M151G/A173R/F176V/G270R/E273V | + |
| 244 | C43A/E114K/G128T/M151G/L165F/F176V/D237A | + |
| 246 | C43A/M151Q/L165Y/F176V/D237C/E273V | + |
| 248 | P63F/L76V/M151R/F176V | + |
| 250 | P63F/L76V/M151N/F176V | + |
| 252 | P63L/L76V/M151N/F176V | + |
| 254 | L76V/G128T/M151N/F176V | + |
| 256 | L76V/S87C/M151N/F176V | + |
| 258 | R48I/L76V/G128T/M151N/F176V | + |
| 260 | P63L/L76V/M151R/F176V | + |
| 262 | L76V/M151R/S160R/F176V | + |
| 264 | P63V/L76V/M151R/F176V | + |
| 266 | L76V/G128T/M151R/F176V | + |
| 268 | R48I/L76V/M151R/F176V | + |
| 270 | I56R/P63H/L76V/K136R/M151R/F176V | + |
| 272 | P63I/L76V/G128H/K136R/M151R/F176V | ++ |
| 274 | G50A/L76V/M151R/F176V | + |
| 276 | L76V/G128H/M151R/F176V | + |
| 278 | I56R/L76V/K136R/M151R/F176V | + |
| 280 | L76V/G128H/E134Q/K136R/M151R/F176V | + |
| 282 | R15C/I56R/L76V/G128H/M151R/F176V | + |
| 284 | P63I/L76V/K136R/M151R/F176V | + |
| 286 | P63I/L76V/M151R/F176V | + |
| 288 | I56R/L76V/M151R/F176V | + |
| 290 | L76V/S87W/G128H/K136R/M151R/F176V | + |

TABLE 4.1-continued

Sequence Information For Tested Variants and Results for Condition A

| Variant No. | Amino Acid Differences (Relative to SEQ ID NO: 4) | Activity FIOPC |
|---|---|---|
| 292 | R15C/L76V/G128H/M151R/F176V | + |
| 294 | P63H/L76V/G128H/K136R/M151R/F176V | + |
| 296 | R15C/I56R/L76V/K136R/M151R/F176V | + |
| 298 | R15C/I56R/L76V/M151R/F176V | + |
| 300 | S30T/A62C/K71V/L76V/G128A/M151T/F176V | ++ |
| 302 | S30T/L76V/G128A/I145C/M151R/F176V | ++ |
| 304 | S30T/A62C/L76V/I145C/M151R/F176V | ++ |
| 306 | S30R/L76V/G128A/I145C/M151R/F176V | ++ |
| 308 | V57I/L76V/M151R/F176V | ++ |
| 310 | L76V/G128Y/M151T/F176V | + |
| 312 | L76V/G128A/M151R/F176V | + |
| 314 | S30R/L76V/G128A/M151R/S160E/F176V | + |
| 316 | S30T/K71V/L76V/G128A/M151R/F176V | ++ |
| 318 | S30R/A62C/L76V/M151R/F176V | + |
| 320 | S30T/A62C/L76V/G128Y/I145C/M151R/F176V | ++ |
| 322 | L76V/G128A/M151R/S160E/F176V | + |
| 324 | S30R/A62C/L76V/G128A/I145C/M151R/F176V | ++ |
| 326 | S30T/L76V/G128Y/M151R/F176V | + |
| 328 | S30T/V44P/V57I/L76V/G128A/M151R/F176V | ++ |
| 330 | S30T/A62F/L76V/G128Y/I145C/M151R/F176V | ++ |
| 332 | S30T/L76V/M151R/F176V | + |
| 334 | L76V/G128A/I145C/M151R/F176V | + |
| 336 | V57I/A62C/L76V/G128Y/M151T/F176V | ++ |
| 338 | S30R/L76V/M151R/F176V | + |

HTP Assay Condition B Summary and Results:

Cells grown in 96 well plates were lysed with 200 uL Lysis Buffer (1 mg/mL lysozyme, 0.5 mg/mL polymyxin B sulfate (PMBS) and 50 mM BisTris buffer, pH=6.3. The reaction conditions for a 300 uL reaction comprised: 20 g/L substrate compound (2), 30 g/L α-ketoglutaric acid; 0.08 g/L L-ascorbic acid; 0.5 mM Mohr's salt; 50 mM Bis-Tris buffer pH=6.3, 80 uL crude lysate and reaction temperature at about 25C (room temperature) for about 24 hours. Plates were sealed with an O$_2$ permeable seal and incubated in a 2" throw Kuhner at 200 rpm and 85% relative humidity. The activity was measured relative to SEQ ID NO:4, calculated as the % conversion of the product formed per % conversion of the corresponding SEQ ID NO:4 (SEQ ID NO:134 of WO2013/169725A2) under the specified reaction conditions. The percent conversion was quantified by dividing the area of the product peak by the sum of the areas of the substrate, product and impurities/side product peaks as determined by LCMS analysis.

TABLE 4.2

Sequence Information and Results for Condition B

| Variant No: | Amino Acid Differences (Relative to SEQ ID NO: 4) | Activity FIOPC |
|---|---|---|
| 420 | S30T/I56R/L76V/M151N/S160R/F176V | ++ |
| 422 | S30T/I56R/L76V/K136R/M151R/S160R/F176V | ++ |
| 424 | L76V/S87C/G128T/K136R/M151N/L165Y/F176V | ++ |
| 426 | S30R/L76V/M151R/S160R/L165Y/F176V/S240H/A256D | ++ |
| 428 | S30R/C37I/L76V/A101G/M151T/P153G/L165Y/F176V/S240H/L269I | ++ |
| 430 | L76V/M151T/S160R/L165Y/F176V/S240H | ++ |
| 432 | S30T/I56R/L76V/M151R/S160R/F176V | ++ |
| 434 | S30R/L76V/A101G/M151T/S160R/L165Y/F176V/S240H | ++ |
| 436 | S30R/C37I/L76V/M151R/S160R/F176V | ++ |
| 438 | L76V/M151R/S160R/F176V/S263E/R274Y | ++ |
| 440 | S30R/L76V/M151R/S160R/L165Y/F176V | ++ |
| 442 | C37I/K39R/A62C/L76V/A101G/M151R/S160R/F176V | ++ |
| 444 | S30R/C37I/K39R/A62C/L76V/M151R/S160R/F176V/S240H/A256D | ++ |
| 446 | C43A/V58M/L76V/M151R/S160R/F176V/I213E/R266Q/R274Y | + |
| 448 | S30R/L76V/M151T/S160R/F176V | + |
| 450 | C43A/L76V/M151R/S160R/F176V/E178C/F180Y/V184F/I213E/S263D | + |
| 452 | L76V/M151R/S160R/F176V/R274P | + |
| 454 | C37I/K39R/L76V/M151R/S160R/F176V | + |
| 456 | L76V/K136R/M151R/S160R/F176V | + |
| 458 | L76V/K136N/M151R/S160R/F176V/R274P/G275A | + |
| 460 | S30T/L76V/M151R/S160R/F176V | + |
| 462 | C43A/V58M/L76V/M151R/S160R/F176V/F180Y/V184F | + |
| 464 | L76V/M151R/S160R/F176V/R274P/Y280L | + |

HTP Assay Condition C Summary and Results:

Cells grown in 96 well plates were lysed with 200 uL Lysis Buffer (1 mg/mL lysozyme, 0.5 mg/mL polymyxin B sulfate (PMBS) and 50 mM BisTris buffer, pH=6.3 The enzyme was expressed from the pJV900 expression vector for assay Condition C. The reaction conditions for a 300 uL reaction comprised: 20 g/L substrate compound (2), 30 g/L α-ketoglutaric acid; 1.75 g/L L-ascorbic acid; 0.5 mM Mohr's salt; 50 mM Bis-Tris buffer pH=6.3, 15 uL crude lysate and reaction temperature at about 25° C. (room temperature) for about 24 hours. Plates were sealed with an O$_2$ permeable seal and incubated in 2" throw Kuhner at 200 rpm and 85% relative humidity. Activity relative to SEQ ID NO: 4 was calculated as the percent conversion of the product formed per % conversion of the corresponding SEQ ID NO:4, under the specified reaction conditions. The % conversion was quantified by dividing the area of the dansyl chloride derivatized product peak by the sum of the areas of the dansyl chloride derivatized substrate, product and impurities/side product peaks as determined by HPLC analysis.

TABLE 4.3

HTP Assay Results for Assay Condition C

| SEQ ID NO: | Amino Acid Differences (Relative to SEQ ID NO: 4) | Activity FIOPC |
|---|---|---|
| 466 | S30R/C37I/L76V/E115G/M151R/S160R/F176V | ++ |
| 468 | S30R/C37L/L76V/M151R/S160R/F176V | ++ |
| 470 | S30A/C37I/L76V/M151R/S160R/F176V | ++ |
| 472 | S30E/C37I/L76V/M151R/S160R/F176V | ++ |

TABLE 4.3-continued

HTP Assay Results for Assay Condition C

| SEQ ID NO: | Amino Acid Differences (Relative to SEQ ID NO: 4) | Activity FIOPC |
|---|---|---|
| 474 | S30R/C37I/L76V/I94L/M151R/S160R/F176V | ++ |
| 476 | S30R/C37I/D55E/L76V/M151R/S160R/F176V | ++ |
| 478 | S30R/C37I/L76V/E114N/M151R/S160R/F176V | ++ |
| 480 | S30R/C37I/L76V/M151R/S160C/F176V | ++ |
| 482 | S30N/C37I/L76V/M151R/S160R/F176V | ++ |
| 484 | S30R/C37I/V58T/L76V/M151R/S160R/F176V | ++ |
| 486 | S30R/C37I/K39T/L76V/M151R/S160R/F176V | ++ |
| 488 | S30R/S33T/C37I/L76V/M151R/S160R/F176V | ++ |
| 490 | S30R/C37I/K39P/L76V/M151R/S160R/F176V | ++ |
| 492 | S30R/C37I/L76V/E114S/M151R/S160R/F176V | ++ |
| 494 | S30R/C37I/L76V/E114Q/M151R/S160R/F176V | ++ |
| 496 | S30T/C37I/L76V/M151R/S160R/F176V | ++ |
| 498 | S30R/C37I/L76V/M151R/S160R/F176V/V277M | ++ |
| 500 | S30R/C37I/A62G/L76V/M151R/S160R/F176V | ++ |
| 502 | S30R/C37I/L76V/M151G/S160R/F176V | ++ |
| 504 | S30R/C37I/L76V/M151R/S160R/F176V/V277K | ++ |
| 506 | S30V/C37I/L76V/M151R/S160R/F176V | ++ |
| 508 | S30R/C37I/A62T/L76V/M151R/S160R/F176V | ++ |
| 510 | S30R/C37I/L76V/S107A/M151R/S160R/F176V | ++ |
| 512 | S30G/C37I/L76V/M151R/S160R/F176V | ++ |
| 514 | S30R/C37I/L76V/E114G/M151R/S160R/F176V | ++ |
| 516 | S30R/C37I/L76V/M151R/S160R/F176V/V277R | ++ |
| 518 | S30R/C37I/N61D/L76V/M151R/S160R/F176V | ++ |
| 520 | S30R/C37I/L76V/V95I/M151R/S160R/F176V | ++ |
| 522 | S30R/C37I/L76V/M151R/S160R/F176V/V277E | ++ |
| 524 | S30R/C37I/A62R/L76V/M151R/S160R/F176V | ++ |
| 526 | S30R/C37I/L76V/V97A/M151R/S160R/F176V | ++ |
| 528 | S30R/C37I/L76V/S98P/M151R/S160R/F176V | ++ |
| 530 | S30R/C37I/L76V/A130L/M151R/S160R/F176V | ++ |
| 532 | S30R/C37I/A62E/L76V/M151R/S160R/F176V | ++ |
| 534 | S30R/C37I/L76V/M151R/S160R/F176V/H271Q | ++ |
| 536 | S30R/C37I/L76V/L119V/M151R/S160R/F176V | ++ |
| 538 | S30R/C37I/L76V/S107M/M151R/S160R/F176V | ++ |
| 540 | S30R/C37I/Q52P/L76V/M151R/S160R/F176V | ++ |
| 542 | S30R/C37I/L76V/Y109F/M151R/S160R/F176V | ++ |
| 544 | S30R/C37I/N61D/A62G/L76V/V97A/M151R/S160R/F176V | ++ |
| 546 | H4P/S30R/C37I/N61D/A62G/L76V/V97A/M151R/S160R/F176V/H271Q | ++ |
| 548 | S30R/C37I/A62G/L76V/V97A/M151R/S160R/F176V/H271Q | ++ |
| 550 | S30R/C37I/A62G/L76V/V97A/M151R/S160R/F176V | ++ |
| 552 | S30R/C37I/L76V/V97A/M151R/S160R/F176V/H271Q | ++ |
| 554 | S30R/C37I/N61D/L76V/V97A/M151R/S160R/F176V/H271Q | ++ |
| 556 | S30R/S33T/C37I/A62G/L76V/V97A/L119V/M151R/S160R/F176V/H271Q | ++ |
| 558 | S30R/C37I/N61D/A62E/L76V/V97A/L119V/M151R/S160R/F176V | ++ |
| 560 | S30R/C37I/N61D/A62T/L76V/V97A/L119V/M151R/S160R/F176V/H271Q | ++ |
| 562 | S30R/C37I/N61D/A62E/L76V/V97A/M151R/S160R/F176V/H271Q | ++ |
| 564 | S30R/C37I/A62T/L76V/V97A/M151R/S160R/F176V/H271Q | ++ |
| 566 | S30R/C37I/A62R/L76V/V97A/D124E/M151R/S160R/F176V | ++ |
| 568 | S30R/C37I/A62E/L76V/V97A/M151R/S160R/F176V/H271Q | ++ |
| 570 | S30R/C37I/A62E/L76V/I94L/V97A/L119V/M151R/S160R/F176V | ++ |
| 572 | S30R/C37I/A62G/L76V/V97A/S98P/M151R/S160R/F176V | ++ |
| 574 | S30R/C37I/A62T/L76V/V97A/L119V/M151R/S160R/F176V/H271Q | ++ |
| 576 | S30R/C37I/A62E/L76V/V97A/M151R/S160R/F176V | ++ |
| 578 | S30R/C37I/A62T/L76V/V97A/S98P/M151R/S160R/F176V | ++ |
| 580 | S30R/C37I/A62R/L76V/V97A/M151R/S160R/F176V | ++ |
| 582 | S30R/C37I/N61D/A62T/L76V/V97A/M151R/S160R/F176V/H271Q | ++ |
| 584 | S30R/C37I/L76V/V97A/L119V/M151R/S160R/F176V/H271Q | ++ |
| 586 | S30R/C37I/L76V/V97A/S98P/M151R/S160R/F176V | ++ |
| 588 | S30R/C37I/N61D/L76V/V97A/M151R/S160R/F176V | ++ |
| 590 | S30R/C37I/N61D/A62G/L76V/V97A/S98P/M151R/S160R/F176V/H271Q | ++ |
| 592 | S30R/C37I/A62R/L76V/V97A/M151R/S160R/F176V/H271Q | ++ |
| 594 | S30R/S33T/C37I/L76V/V97A/L119V/M151R/S160R/F176V | ++ |
| 596 | S30R/S33T/C37I/N61D/A62G/L76V/V97A/A130L/M151R/S160R/F176V/H271Q | ++ |
| 598 | S30T/C37I/L76V/V95I/V97A/M151R/S160R/F176V | ++ |
| 600 | S30R/C37I/V97A/M151R/S160R/F176V | ++ |
| 602 | S30R/C37I/V97A/M151R/S160R/F176V/V277M | ++ |

HTP Assay Condition D Summary and Results:

Cells grown in 96 well plates were lysed with 200 uL Lysis Buffer (1 mg/mL lysozyme, 0.5 mg/mL polymyxin B sulfate (PMBS) and 50 mM phosphate buffer, pH=6.3. The enzyme was expressed form the pJV900 expression vector for assay condition D. The reaction conditions for a 300 uL reaction comprised: 20 g/L substrate compound (2), 30 g/L α-ketoglutaric acid; 1.75 g/L L-ascorbic acid; 0.5 mM Mohr's salt; 50 mM Bis-Tris buffer pH=6.3, with 15 uL crude lysate and reaction temperature at about 25C (room temperature) for about 24 hours. Plates were sealed with an O2 permeable seal and incubated in 2" throw Kuhner at 200 rpm and 85% relative humidity. Activity relative to SEQ ID NO: 4 was calculated as the percent conversion of the product formed per % conversion of the corresponding SEQ ID NO:4, under the specified reaction conditions. The percent (%) conversion was quantified by dividing the area of the dansyl chloride derivatized product peak by the sum of the areas of the dansyl chloride derivatized substrate, product and impurities/side product peaks as determined by HPLC analysis. Regioselectivity relative to SEQ ID NO:4 was calculated by dividing the area of the desired regioisomer (2S,5S) peak by the sum of the areas of the undesired regioisomer (2S,3S) peak and the desired regioisomer (2S, 5S) peak and multiplying by 100.

dividing the area of the dansyl chloride derivatized product peak by the sum of the areas of the dansyl chloride derivatized substrate, product and impurities/side product peaks as determined by HPLC analysis. The specific activity of each variant relative to SEQ ID NO: 604 was calculated as the percent (%) conversion of the product formed per % conversion of the corresponding SEQ ID NO: 604 under the specified reaction conditions normalized for proline hydroxylase peak area as determined by SEC. The percent (%) conversion was quantified by dividing the area of the product peak by the sum of the areas of the substrate, product and impurities/side product peaks as determined by HPLC analysis.

TABLE 4.4

HTP Assay Results for Assay Condition D

| SEQ ID NO: | Amino Acid Differences (Relative to SEQ ID NO: 4) | Activity FIOPC | Regioselectivity |
|---|---|---|---|
| 604 | S30R/C37I/V57A/V97A/M151R/S160R/F176V | ++ | 99.07 |
| 466 | S30R/C37I/L76V/E115G/M151R/S160R/F176V | ++ | 93.40 |
| 476 | S30R/C37I/D55E/L76V/M151R/S160R/F176V | ++ | 96.79 |
| 480 | S30R/C37I/L76V/M151R/S160C/F176V | ++ | 94.64 |
| 484 | S30R/C37I/V58T/L76V/M151R/S160R/F176V | ++ | 92.86 |
| 498 | S30R/C37I/L76V/M151R/S160R/F176V/V277M | ++ | 93.55 |
| 502 | S30R/C37I/L76V/M151G/S160R/F176V | ++ | 95.90 |
| 504 | S30R/C37I/L76V/M151R/S160R/F176V/V277K | ++ | 93.84 |
| 510 | S30R/C37I/L76V/S107A/M151R/S160R/F176V | ++ | 94.40 |
| 516 | S30R/C37I/L76V/M151R/S160R/F176V/V277R | ++ | 92.27 |
| 522 | S30R/C37I/L76V/M151R/S160R/F176V/V277E | ++ | 93.30 |
| 538 | S30R/C37I/L76V/S107M/M151R/S160R/F176V | ++ | 96.27 |
| 542 | S30R/C37I/L76V/Y109F/M151R/S160R/F176V | ++ | 94.32 |
| 606 | S30R/C37I/V57A/L76V/M151R/S160R/F176V | + | 99.07 |
| 608 | S30R/C37I/L76V/E115C/M151R/S160R/F176V | + | 94.17 |
| 610 | S30R/C37I/V58L/L76V/M151R/S160R/F176V | + | 94.14 |
| 612 | L76V/M151R/S160R/F176V/S30R/C37I/V58S | + | 92.50 |
| 614 | S30R/C37I/D55S/L76V/M151R/S160R/F176V | + | 95.27 |
| 616 | S30R/C37I/V58Y/L76V/M151R/S160R/F176V | + | 92.05 |
| 618 | S30R/C37I/V58C/L76V/M151R/S160R/F176V | + | 94.25 |
| 620 | S30R/C37I/L76V/M151R/S160R/Q166L/F176V | + | 95.43 |
| 622 | S30R/C37I/V58H/L76V/M151R/S160R/F176V | + | 91.71 |
| 624 | S30R/C37I/L76V/M151R/S160R/M168L/F176V | + | 86.20 |
| 626 | S30R/C37I/L76V/M151R/S160R/M168I/F176V | + | 85.28 |
| 628 | S30R/C37I/V58N/L76V/M151R/S160R/F176V | + | 91.67 |
| 630 | S30R/C37I/V57L/L76V/M151R/S160R/F176V | + | 51.06 |
| 632 | S30R/C37I/L76V/M151R/S160R/M168R/F176V | + | 97.04 |
| 634 | S30R/C37I/L76V/M151R/S160R/Q166V/F176V | + | 95.28 |
| 636 | S30R/C37I/L76V/M151R/A156S/S160R/F176V | + | 95.86 |
| 638 | S30R/C37I/V57T/L76V/M151R/S160R/F176V | + | 100.00 |

HTP Assay Condition E Summary and Results:

Cells grown in 96 well plates were lysed with 200 uL Lysis Buffer (1 mg/mL lysozyme, 0.5 mg/mL polymyxin B sulfate (PMBS) and 50 mM phosphate buffer, pH=6.3. The enzyme was expressed from the pJV900 expression vector for these assay conditions E. The reaction conditions for a 300 uL reaction comprised: 20 g/L substrate compound (2), 30 g/L α-ketoglutaric acid; 1.75 g/L L-ascorbic acid; 0.5 mM Mohr's salt; 50 mM Bis-Tris buffer pH=6.3, 15 uL crude lysate and reaction temperature at about 25C (room temperature) for about 24 hours. Plates were sealed with an O₂ permeable seal and incubated in 2" throw Kuhner at 200 rpm and 85% relative humidity. The activity of the variants relative to SEQ ID NO: 604 was calculated as the % conversion of the product formed per % conversion of the corresponding SEQ ID NO: 604 under the specified reaction conditions. The percent (%) conversion was quantified by

TABLE 4.5

HTP Assay Results for Assay Condition E

| SEQ ID NO: | Amino Acid Differences (Relative to SEQ ID NO: 604) | Activity FIOPC | Specific Activity FIOPC |
|---|---|---|---|
| 640 | A62D/E114S/H271W | + | + |
| 642 | R30N/A62E/E114S/E273G | + | + |
| 644 | R30N/A57V/A62E/L76V/A97V/E114S/H271R/E273T | + | + |
| 646 | R30N/A62D/E114S/H271W/E273T | + | + |
| 648 | R30N/N61D/A62E/E114S/H271W/E273T | + | + |
| 650 | R30N/N61D/A62E/E114N/H271W | + | + |
| 652 | R30N/A62E/E114N/H271W | + | + |
| 654 | R30N/N61D/A62D/E114S/H271W | + | + |
| 656 | R30N/A62D/E114N/H271W/E273T | + | + |
| 658 | R30N/A62E/E114S/H271W/E273T | + | + |
| 660 | R30N/N61D/A62E/E114N/H271W/E273T | + | + |
| 662 | R30N/A62D/H271R | + | + |
| 664 | R30N/N61D/A62E/E114K/H271W/E273G | + | + |

HTP Assay Condition F Summary and Results:

Cells grown in 96-well plates were lysed with 200 uL Lysis Buffer (1 mg/mL lysozyme, 0.5 mg/mL polymyxin B sulfate (PMBS) and 50 mM phosphate buffer, pH=6.3. The enzyme was expressed form the pJV900 expression vector for the assay conditions F. The reaction conditions for a 300 uL reaction comprised: 20 g/L substrate compound (2), 30 g/L α-ketoglutaric acid; 1.75 g/L L-ascorbic acid; 0.5 mM Mohr's salt; 50 mM Bis-Tris buffer pH=6.3. 15 uL crude lysate was pre-incubated with all the reaction components except for the substrate for 2 h at 25° C. (room temperature) after which the substrate (1) was added and the reaction mixture incubated for about 24 hours. Plates were sealed with an O2 permeable seal and incubated in 2" throw Kuhner at 200 rpm and 85% relative humidity. The activity of the variants relative to SEQ ID NO: 604 was calculated as the % conversion of the product formed per % conversion of the corresponding SEQ ID NO: 604 under the specified reaction conditions. The percent (%) conversion was quantified by dividing the area of the dansyl chloride derivatized product peak by the sum of the areas of the dansyl chloride derivatized substrate, product and impurities/side product peaks as determined by HPLC analysis. The specific activity of each variant relative to SEQ ID NO: 604 was calculated as the percent (%) conversion of the product formed per % conversion of the corresponding SEQ ID NO: 604 under the specified reaction conditions normalized for proline hydroxylase peak area as determined by SEC. The percent (%) conversion was quantified by dividing the area of the product peak by the sum of the areas of the substrate, product and impurities/side product peaks as determined by HPLC analysis.

TABLE 4.6

HTP Assay Results for Assay Condition F

| SEQ ID NO: | Amino Acid Differences (Relative to SEQ ID NO: 604) | Activity FIOPC | Specific Activity FIOPC |
|---|---|---|---|
| 666 | R30N/A62D/E114S/S240T/H271W/E273T | + | + |
| 668 | R30N/A62D/E114S/S240Q/H271W/E273T | + | + |
| 670 | R30N/A62D/E114S/G207M/H271W/E273T | + | + |
| 672 | R30N/A62D/E114S/T189I/H271W/E273T | + | + |
| 674 | R26G/R30N/A62D/E114S/H271W/E273T | + | + |
| 676 | R30N/A62D/E114S/G207W/H271W/E273T | + | + |
| 678 | R30N/A62D/E114S/F180M/H271W/E273T | + | + |
| 680 | S24T/R30N/A62D/E114S/H271W/E273T | + | + |
| 682 | R30N/A62D/E114S/T189H/H271W/E273T | + | + |
| 684 | R30N/A62D/T82K/E114S/H271W/E273T | + | + |
| 686 | R30N/A62D/E114S/A173Y/H271W/E273T | + | + |
| 688 | R30N/A62D/E114S/G210M/H271W/E273T | + | + |
| 690 | R30N/A62D/E114S/S127R/H271W/E273T | + | + |
| 692 | R30N/A62D/E114S/S127T/H271W/E273T | + | + |
| 694 | R30N/A62D/E114S/G207C/H271W/E273T | + | + |
| 696 | R30N/A62D/E114S/D192Q/H271W/E273T | + | + |
| 698 | R30N/A62D/E114S/S263D/H271W/E273T | + | + |
| 700 | R30N/A62D/E114S/L142Q/H271W/E273T | + | + |
| 702 | R30N/A62D/E114S/R191L/H271W/E273T | + | + |
| 704 | R30N/A62D/S72V/E114S/H271W/E273T | + | + |
| 706 | R30N/A62D/T82R/E114S/H271W/E273T | + | + |
| 708 | R30N/A62D/E114S/H271W/E273T | + | + |
| 710 | R30N/A62D/E114S/Q186R/H271W/E273T | + | + |
| 712 | R30N/A62D/E114S/A175Q/H271W/E273T | + | + |
| 714 | R30N/A62D/E114S/V188I/H271W/E273T | + | + |
| 716 | R30N/A62D/E114S/P187C/H271W/E273T | + | + |

HTP Assay Condition G Summary and Results:

Cells grown in 96 well plates were lysed with 200 uL Lysis Buffer (1 mg/mL lysozyme, 0.5 mg/mL polymyxin B sulfate (PMBS) and 50 mM phosphate buffer, pH=6.3. The enzyme was expressed form the pJV900 expression vector with a18c RBS for assay conditions G. The reaction conditions for a 300 uL reaction comprised: 20 g/L substrate compound (2), 30 g/L α-ketoglutaric acid; 1.75 g/L L-ascorbic acid; 0.5 mM Mohr's salt; 50 mM Bis-Tris buffer pH=6.3. 30 uL crude lysate was pre-incubated with all the reaction components except for the substrate for 2 h at 25 C (room temperature) after which the substrate (1) was added and the reaction mixture incubated for about 24 hours. Plates were sealed with an O2 permeable seal and incubated in 2" throw Kuhner at 200 rpm and 85% relative humidity. The activity of each variant relative to SEQ ID NO: 604 was calculated as the % conversion of the product formed per % conversion of the corresponding SEQ ID NO: 604 under the specified reaction conditions. The percent (%) conversion was quantified by dividing the area of the dansyl chloride derivatized product peak by the sum of the areas of the dansyl chloride derivatized substrate, product and impurities/side product peaks as determined by HPLC analysis. The specific activity of each variant relative to SEQ ID NO: 604 was calculated as the % conversion of the product formed per % conversion of the corresponding SEQ ID NO: 604 under the specified reaction conditions normalized for proline hydroxylase peak area as determined by SEC. The percent (%) conversion was quantified by dividing the area of the product peak by the sum of the areas of the substrate, product and impurities/side product peaks as determined by HPLC analysis.

TABLE 4.7

HTP Assay Results for Assay Condition G

| SEQ ID NO: | Amino Acid Differences (Relative to SEQ ID NO: 604) | Activity FIOPC | Specific Activity FIOPC |
|---|---|---|---|
| 718 | R30N/A62D/E114S/S127R/K161G/V188I/T189P/H271W/E273T | + | + |
| 720 | R30N/A62D/E114S/K161G/T189H/H271W/E273T | + | + |
| 722 | R30N/A62D/E114S/S127R/K161G/E185V/H271W/E273T | + | + |
| 724 | S24T/R30N/A62D/E114S/T189H/D192W/H271W/E273T | + | + |
| 726 | R30N/A62D/E114S/K161G/E185V/T189H/H271W/E273T | + | + |
| 728 | R30N/A62D/E114S/K161G/E185V/V188I/T189H/H271W/E273T | + | + |
| 730 | R30N/A62D/E114S/S240I/H271W/E273T | + | + |
| 732 | R30N/A62D/E114S/Q186R/T189I/S240I/H271W/E273T | + | + |
| 734 | R30N/A62D/E114S/S240Q/H271W/E273T | + | + |
| 736 | R30N/A62D/S72V/E114S/Q186G/M193I/H271W/E273T | + | + |

TABLE 4.7-continued

HTP Assay Results for Assay Condition G

| SEQ ID NO: | Amino Acid Differences (Relative to SEQ ID NO: 604) | Activity FIOPC | Specific Activity FIOPC |
|---|---|---|---|
| 738 | R30N/A62D/E114S/G210M/S240Q/H271W/E273T | + | + |
| 740 | R30N/A62D/E114S/E178R/V184L/Q186G/H271W/E273T | + | + |
| 742 | R30N/A62D/E114S/Q186R/T189I/H271W/E273T | + | + |
| 744 | R30N/A62D/E114S/S240Q/S263G/H271W/E273T | + | + |
| 746 | R30N/A62D/E114S/Q186G/T189I/S240I/H271W/E273T | + | + |
| 748 | R30N/A62D/E114S/V184L/G210M/S240Q/H271W/E273T | + | + |
| 750 | R30N/A62D/E114S/T189I/S240I/H271W/E273T | + | + |
| 752 | R30N/A62D/S72V/E114S/S240Q/H271W/E273T | + | + |
| 754 | R30N/A62D/E114S/S127T/S240Q/H271W/E273T | + | + |
| 756 | R30N/A62D/E114S/G207R/H271W/E273T | + | + |
| 758 | R30N/A62D/E114S/V184L/Q186G/T189I/S240Q/H271W/E273T | + | + |
| 760 | R30N/A62D/E114S/A173Y/S263G/H271W/E273T | + | + |
| 762 | R30N/A62D/E114S/P187H/S263G/H271W/E273T | + | + |
| 764 | R30N/A62D/E114S/P187H/H271W/E273T | + | + |
| 766 | R30N/A62D/E114S/S263G/H271W/E273T | + | + |
| 768 | R30N/A62D/E114S/V176K/P187H/S263G/H271W/E273T | + | + |
| 770 | R30N/A62D/E114S/V176K/P187H/H271W/E273T | + | + |
| 772 | R30N/A62D/E114S/A173Y/H271W/E273T | + | + |
| 774 | S24T/R26A/R30N/A62D/T82K/E114S/G128A/K161P/A173Y/F180M/K198A/I213L/F233E/S240T/H271W/E273T | + | + |
| 776 | R26A/R30N/A62D/T82K/E114S/F233Y/H271W/E273T | + | + |
| 778 | R30N/A62D/S72E/E114S/A173Y/T189A/F233E/H271W/E273T | + | + |
| 780 | R30N/A62D/T82K/E114S/G128A/I213L/H271W/E273T | + | + |
| 782 | S24T/R26G/R30N/A62D/S72E/E114S/C158N/A173K/I213L/F233Y/H271W/E273T | + | + |
| 784 | R26A/R30N/A62D/S72E/E114S/C158N/D192P/S240T/M241C/H271W/E273T | + | + |
| 786 | S24T/R26A/R30N/A62D/S72E/E114S/K161P/F233E/H271W/E273T | + | + |
| 788 | R26G/R30N/A62D/T82K/E114S/G128A/K161P/F180M/K198A/H271W/E273T | + | + |
| 790 | S24T/R26A/R30N/A62D/S72E/E114S/C158N/K161P/T189A/H271W/E273T | + | + |
| 792 | R26G/R30N/A62D/T82K/E114S/H271W/E273T | + | + |
| 794 | R26A/R30N/A62D/S72E/E114S/G128A/C158N/K198A/H271W/E273T | + | + |
| 796 | R26A/R30N/A62D/S72E/E114S/C158N/K161P/D192P/H271W/E273T | + | + |
| 798 | R30N/A62D/E114S/C158N/H271W/E273T | ++ | + |
| 800 | S24T/R26A/R30N/A62D/E114S/G128A/F180M/G207K/H271W/E273T | + | + |
| 802 | R26G/R30N/A62D/T82K/E114S/K161P/A173Y/F180M/D192A/F233E/H271W/E273T | + | + |
| 804 | S24T/R26A/R30N/A62D/E114S/C158N/T189A/D192A/S225A/H271W/E273T | + | + |
| 806 | S24T/R26A/R30N/A62D/E114S/A173Y/H271W/E273T | + | + |
| 808 | S24T/R26A/R30N/A62D/S72E/E114S/K161P/A173K/S240T/H271W/E273T | + | + |
| 810 | R26A/R30N/A62D/T82K/E114S/C158N/K161P/H271W/E273T | ++ | + |
| 812 | S24T/R26G/R30N/A62D/S72E/T82K/E114S/G128A/C158N/K161P/T189A/S240T/M241C/H271W/E273T | + | + |
| 814 | R30N/A62D/E114S/C158N/A173Y/I213L/H271W/E273T | + | + |
| 816 | S24T/R26A/R30N/A62D/S72E/T82K/E114S/G128A/F233Y/H271W/E273T | + | + |
| 818 | S24T/R26A/R30N/A62D/T82K/E114S/C158N/K161P/F180M/F233E/H271W/E273T | + | + |
| 820 | R30N/A62D/E114S/I213L/F233E/H271W/E273T | + | + |
| 822 | S24T/R30N/A62D/E114S/C158N/K161P/V176D/F233E/H271W/E273T | + | + |
| 824 | R26A/R30N/A62D/S72E/T82K/E114S/A173Y/D192A/S240T/H271W/E273T | + | + |
| 826 | S24T/R26A/R30N/A62D/S72E/T82K/E114S/G128A/A173Y/V176D/I213L/S240T/H271W/E273T | + | + |
| 828 | R30N/A62D/S72E/E114S/C158N/H271W/E273T | + | + |
| 830 | S24T/R26A/R30N/A62D/E114S/G128A/A173K/T189A/S225A/F233E/H271W/E273T | + | + |
| 832 | R30N/A62D/S72E/T82K/E114S/A173K/F180M/G207R/I213L/S225A/F233E/H271W/E273T | + | + |
| 834 | S24T/R26A/R30N/A62D/E114S/T189A/H271W/E273T | + | + |
| 836 | S24T/R30N/A62D/E114S/A173K/H271W/E273T | + | + |
| 838 | R26A/R30N/A62D/E114S/A173Y/V176D/F180M/T189A/D192P/S225A/M241C/H271W/E273T | + | + |
| 840 | R30N/A62D/E114S/T189A/E273A | + | + |
| 842 | R26A/R30N/A62D/S72E/E114S/K161P/H271W/E273T | + | + |
| 844 | R26G/R30N/A62D/S72E/E114S/C158N/A173K/T189A/F233E/H271W/E273T | + | + |
| 846 | R26A/R30N/A62D/S72E/E114S/K161P/S225A/H271W/E273T | + | + |
| 848 | R30N/A62D/E114S/A173Y/F180M/H271W/E273T | + | + |
| 850 | S24T/R26A/R30N/A62D/S72Y/E114S/G128A/T189A/S240C/H271W/E273T | + | + |
| 852 | R26A/R30N/A62D/S72E/E114S/A173Y/F180M/H271W/E273T | + | + |
| 854 | R26A/R30N/A62D/E114S/K161P/T189A/D192P/F233E/S240T/H271W/E273T | + | + |
| 856 | R30N/A62D/S72E/T82K/E114S/I213L/F233E/H271W/E273T | + | + |
| 858 | R26G/R30N/A62D/S72Y/E114S/C158N/H271W/E273T | + | + |
| 860 | E27T/R30N/A62D/T82R/E114S/A175Q/D192Q/H271W/E273T | + | + |
| 862 | E27T/R30N/A62D/T82R/E114S/L142S/D192Q/S263D/H271W/E273T | + | + |
| 864 | R30N/A62D/E114S/L142Q/S263D/H271W/E273T | + | + |
| 866 | R30N/A62D/E114S/D192Q/H271W/E273T | + | + |
| 868 | E27T/R30N/A62D/E114S/G207W/S240R/S263D/H271W/E273T | + | + |
| 870 | R30N/A62D/T82R/E114S/L142S/A175Q/F180M/G207W/A256R/H271W/E273T | + | + |
| 872 | E27T/R30N/A62D/E114S/G207W/A236S/S263D/H271W/E273T | ++ | + |

TABLE 4.7-continued

HTP Assay Results for Assay Condition G

| SEQ ID NO: | Amino Acid Differences (Relative to SEQ ID NO: 604) | Activity FIOPC | Specific Activity FIOPC |
|---|---|---|---|
| 874 | R30N/A62D/T82R/E114S/G207W/A256R/S263D/H271W/E273T | + | + |
| 876 | R30N/A62D/E114S/G128F/L142Q/R191L/D192Q/S263D/H271W/E273T | + | + |
| 878 | R30N/A62D/T82R/E114S/G128N/H271W/E273T | + | + |
| 880 | E13K/R30N/A62D/E114S/L142S/A175Q/F180M/S263D/H271W/E273T | + | + |
| 882 | R30N/A62D/T82R/E114S/G207W/S263D/H271W/E273T | + | + |
| 884 | R30N/A62D/T82R/C86E/E114S/R191L/D192Q/S263D/H271W/E273T | + | + |
| 886 | E13K/E27T/R30N/A62D/T82R/C86E/E114S/G207W/A256R/S263D/H271W/E273T | + | + |
| 888 | E27T/R30N/A62D/T82R/E114S/F180M/D192Q/H271W/E273T | + | + |
| 890 | R30N/A62D/T82R/E114S/A175Q/F180M/C238T/S240R/S263D/H271W/E273T | + | + |
| 892 | E27T/R30N/A62D/E114S/A256R/H271W/E273T | + | + |
| 894 | E27T/R30N/A62D/E114S/S263D/H271W/E273T | + | + |
| 896 | E27T/R30N/A62D/T82R/E114S/G128F/D192Q/A256R/H271W/E273T | + | + |
| 898 | R30N/A62D/C86E/E114S/G207W/S263D/H271W/E273T | + | + |
| 900 | R30N/A62D/E114S/G128K/L142S/A256R/S263D/H271W/E273T | + | ++ |
| 902 | R30N/A62D/E114S/R191L/D192Q/G207W/S263D/H271W/E273T | + | + |
| 904 | R30N/A62D/T82R/E114S/G128F/S263D/H271W/E273T | + | + |
| 906 | R30N/A62D/E114S/E222Q/H271W/E273T | − | + |
| 908 | R30N/A62D/E114S/D195A/H271W/E273T | − | + |
| 910 | R30N/A62D/E114S/E259G/H271W/E273T | − | + |
| 912 | R30N/A62D/N77L/E114S/H271W/E273T | − | + |
| 914 | R30N/A62D/E114S/E217G/H271W/E273T | − | + |
| 916 | R30N/A62D/E114S/G128S/H271W/E273T | + | + |
| 918 | R30N/A62D/E114S/L209E/H271W/E273T | − | + |
| 920 | R30N/A62D/E114S/L209G/H271W/E273T | − | + |
| 922 | A14G/R30N/A62D/E114S/H271W/E273T | − | + |
| 924 | R30N/A62D/E114S/I213R/H271W/E273T | + | + |
| 926 | R30N/A62D/E114S/L230E/H271W/E273T | − | ++ |
| 928 | R30N/A62D/E114S/L142G/H271W/E273T | − | + |
| 930 | R30N/A62D/E114S/A218G/H271W/E273T | + | + |
| 932 | R30N/A62D/E114S/T189V/H271W/E273T | + | + |
| 934 | R30N/A62D/E114S/D195G/H271W/E273T | − | + |
| 936 | R30N/A62D/E114S/L200A/H271W/E273T | − | + |
| 938 | R30N/A62D/E114S/E265C/H271W/E273T | − | + |
| 940 | R30N/A62D/E114S/C238G/H271W/E273T | − | ++ |
| 942 | R30N/A62D/E114S/P163E/H271W/E273T | + | + |
| 944 | R30N/A62D/E114S/M241I/H271W/E273T | − | + |
| 946 | R30N/A62D/E114S/I215V/H271W/E273T | − | + |
| 948 | R30N/A62D/E114S/I213G/H271W/E273T | − | + |
| 950 | R30N/A62D/E114S/A218C/H271W/E273T | − | + |
| 952 | R30N/A62D/E114S/C238S/H271W/E273T | − | + |
| 954 | R30N/A62D/E114S/M241V/H271W/E273T | − | ++ |
| 956 | R30N/A62D/E114S/F211S/H271W/E273T | − | + |
| 958 | R30N/A62D/R88H/E114S/H271W/E273T | + | + |
| 960 | R30N/A62D/E114S/E265V/H271W/E273T | − | + |
| 962 | R30N/A62D/E81V/E114S/H271W/E273T | − | + |
| 964 | R30N/A62D/E114S/Q186R/G207R/H271W/E273T | + | + |
| 966 | R30N/A62D/E114S/Q186R/G207M/H271W/E273T | + | + |
| 968 | R30N/A62D/E114S/Q186R/H271W/E273T | + | + |
| 970 | R30N/A62D/E114S/Q186R/T189I/G207R/H271W/E273T | + | + |
| 972 | R30N/A62D/E114S/V184L/Q186G/T189I/G207R/H271W/E273T | + | ++ |
| 974 | R30N/A62D/E114S/V184L/T189I/G207M/H271W/E273T | + | + |
| 976 | R30N/A62D/E114S/V184L/Q186R/G207M/H271W/E273T | + | + |
| 978 | R30N/A62D/E114S/Q186G/T189I/G207R/H271W/E273T | + | + |
| 980 | R30N/A62D/E114S/V184L/G207R/H271W/E273T | + | + |
| 982 | R30N/A62D/E114S/V184L/T189I/G207K/H271W/E273T | + | + |

HTP Assay Condition H Summary and Results:

Cells grown in 96 well plates were lysed with 200 uL Lysis Buffer (1 mg/mL lysozyme, 0.5 mg/mL polymyxin B sulfate (PMBS) and 50 mM phosphate buffer, pH=6.3. The enzyme was expressed from the pJV900 gc RBS expression vector for the assay conditions H. The reaction conditions for a 300 uL reaction comprised: 60 g/L substrate compound (2), 90 g/L α-ketoglutaric acid; 30 mM L-ascorbic acid; 1.5 mM Mohr's salt; 50 mM Bis-Tris buffer pH=6.3. 30 uL crude lysate and reaction temperature at about 25° C. (room temperature) for about 24 hours. Plates were sealed with an $O_2$ permeable seal and incubated in 2" throw Kuhner at 200 rpm and 85% relative humidity. The activity of each variant relative to SEQ ID NO: 810 was calculated as the % conversion of the product formed per % conversion of the corresponding SEQ ID NO: 810 under the specified reaction conditions. % Conversion was quantified by dividing the area of the dansyl chloride derivatized product peak by the sum of the areas of the dansyl chloride derivatized substrate, product and impurities/side product peaks as determined by HPLC analysis. The specific activity for each variant relative to SEQ ID NO: 810 was calculated as the % conversion of the product formed per % conversion of the corresponding SEQ ID NO: 810 under the specified reaction conditions normalized for proline hydroxylase peak area as determined by SEC. The percent conversion (% Conversion) was quantified by dividing the area of the product peak by the sum of the areas of the substrate, product and impurities/side product peaks as determined by HPLC analysis.

TABLE 4.8

HTP Assay Results for Assay Condition H

| SEQ ID NO: | Amino Acid Differences (Relative to SEQ ID NO: 810) | Activity FIOPC | Specific Activity FIOPC |
|---|---|---|---|
| 984 | A156S | + | + |
| 986 | S33T | ++ | + |
| 988 | V95I | + | + |
| 990 | S33K | + | + |
| 992 | S33W | + | + |
| 994 | W40T | ++ | + |
| 996 | S33G | + | + |
| 998 | W40Q | + | + |
| 1000 | A156V | + | + |
| 1002 | A156F | + | + |
| 1004 | S33H | + | +++ |

Example 5

Process for Conversion of Compound (1) to Compound (2) Using Shake Flask Powder (SFP) Preparations In this Example, methods for converting Compound (1) to Compound (2) using SFP preparations are described.

A 200 mL scale reaction using SFP enzyme powder was carried out in a 500 mL jacketed BioStat "Q" fermentation vessel with Rushton impeller, gas sparging loop, thermocouple and dissolved oxygen (DO) probe. The reaction mixture comprised (Condition I): 30 g/L substrate compound (1), 1.5 eq (350 mM) a-ketoglutaric acid; 0.3 eq (70 mM) L-ascorbic acid; 1 mM Mohr's salt; 100 mM potassium phosphate buffer, pH=6.3 (pH adjusted with KOH), 3 g/L protein of SFP enzyme powder preparations. 130 mL of 100 mM pH 6.3 $KPO_4$ buffer was added to the reactor. The DO probe was calibrated at 100% and 0% DO by flowing air or nitrogen respectively at 1.0 SLPM until a steady probe reading was observed. To the stirred (200 rpm) buffer at 0% DO with a nitrogen flow rate of 0.4 SLPM, 6.0 g of L-pipecolinic acid (46.5 mmol), 10.2 g of α-ketoglutaric acid (70 mmol; 1.5 equiv.) and 2.5 g of L-ascorbic acid (14 mmol; 0.3 equiv.) was added to give a homogeneous solution at pH ~2 in ~5 minutes. The pH was adjusted to ~6.3 with 50% w/v (~9 M) KOH (~32-35 mL). After the exotherm (up to ~30-35° C.) subsided, the pH of the resulting solution was adjusted 6.3 via dropwise addition of either 50% w/v KOH or conc. $H_3PO_4$ (pH decreases upon cooling to r.t.). The DO probe should read <10% throughout. 400 mg (1.0 mmol; 5 mM) of Mohr's salt $(NH_4)_2Fe(SO_4)_2*6\ H_2O$ was added to the resulting solution to give a reddish-brown solution. The reddish-brown color should sustain for at least 6 hours when the reaction is under constant nitrogen sparge. 1.0 mL of Antifoam-204 (Aldrich #A6426) was added to the reddish-brown solution to give a reddish-brown cloudy/milky mixture, to this mixture was added within 2-5 minutes 600 mg SFP in 20 mL of 100 mM pH 6.3 K—$PO_4$ buffer to give ~200 mL of a reddish-brown cloudy/milky mixture. The fermentor was placed under automatic feedback DO (at 10% DO) control (variable agitation rate) by switching the incoming gas stream to air (100% DO=oxygen level in air saturated water) at a reaction temperature of 25° C. for about 24 hours.

At specified time points, 5 uL of the reaction mixture were aliquoted into a 96 deep well plate containing 200 ul/well of 5% sodium bicarbonate. A 200 μL volume of 10 mg/mL of dansyl chloride in MeCN was added to each well, the plate heat sealed, and then quickly spun to settle the reaction solution to the bottom of the well. The plate was then heated at 44-45° C. for 1 hour with 600 rpm shaking. After incubation, the plate was centrifuged for 1 min at 4000 rpm. A 20 μL aliquot of supernatant was transferred into a 96 well plate containing 140 ul of water per well for HPLC analysis.

The results are shown in the following table. The relative activity of each variant was calculated as the percent (%) conversion of the product formed per % conversion of SEQ ID NO:4 (i.e., the reference sequence), under the specified reaction conditions. The percent (%) conversion was quantified by dividing the area of the product peak by the sum of the areas of the substrate, product and impurities/side product peaks as determined by HPLC analysis. The peak area of the undesired product peak (2S,3S)-hydroxypipecolic acid expressed as a percentage with respect to the peak area of the desired product (2S,5S)-hydroxypipecolic acid.

TABLE 5.1

Results for SPF Assay Condition I

| SEQ ID NO: | Amino Acid Differences (Relative to SEQ ID NO: 4) | Activity FIOPC | % Conv. | % (2S, 3S) vs. (2S, 5S) |
|---|---|---|---|---|
| 4 | NA | NA | 15 | 13 |
| 44 | M151R/F176V | + | 20 | 13 |
| 436 | S30R/C37I/L76V/M151R/ S160R/F176V | + | 25 | 13 |
| 600 | S30R/C37I/V97A/M151R/ S160R/F176V | + | 50 | 7 |
| 604 | S30R/C37I/V57A/V97A/ M151R/S160R/F176V | + | 35 | 2 |
| 646 | S30N/C37I/V57A/A62D/ V97A/E114S/M151R/ S160R/F176V/H271W/ E273T | + | 40 | 2 |
| 810 | R26A/S30N/C37I/V57A/ A62D/T82K/V97A/E114S/ M151R/C158N/S160R/ K161P/F176V/H271W/ E273T | ++ | 60 | 2 |

Example 6

Process for Conversion of Compound (1) to Compound (2) Using Downstream Process Powder (DSP) Preparations In this Example, methods for converting Compound (1) to Compound (2) using DSP preparations are described.

A 200 mL scale reaction using DSP enzyme powder was carried out in a 500 mL jacketed BioStat "Q" fermentation vessel with Rushton impeller, gas sparging loop, thermocouple and dissolved oxygen (DO) probe.

The reaction mixture comprised: 30 g/L substrate compound (1, Conditions J and K) or 60 g/L substrate compound (1, Condition L), 1.5 eq α-ketoglutaric acid; 70 mM L-ascorbic acid; 1 mM Mohr's salt; 100 mM potassium phosphate buffer pH=6.3 (pH adjusted with KOH), 3 g/L (Condition J) or 6 g/L (Conditions K and L) protein of DSP enzyme powder preparation.

First, 130 mL of 100 mM pH 6.3 K—$PO_4$ buffer was added to the reactor. The DO probe was calibrated at 100% and 0% DO by flowing air or nitrogen respectively at 1.0 SLPM until a steady probe reading was observed. To the stirred (200 rpm) buffer at 0% DO with a nitrogen flow rate of 0.4 SLPM, 6.0 g of L-pipercolinic acid (46.5 mmol, Conditions J and K) or 12 g of L-pipercolinic acid (93 mmol, Condition L), 10.2 g of α-ketoglutaric acid (70 mmol; 1.5 equiv., Conditions J and K) or 20.4 g of α-ketoglutaric acid (140 mmol; 1.5 equiv, Condition L) and 2.5 g of L-ascorbic acid (14 mmol; 0.3 equiv. (Conditions J and K) or 0.15 equiv. (Condition L)) was added to give a homogeneous solution at pH ~2 in ~5 minutes. The pH was adjusted to ~6.3 with 50% w/v (~9 M) KOH (~32-35 mL). After the exotherm (up to ~30-35° C.) subsided, the pH of the resulting solution was adjusted 6.3 via dropwise addition of either 50% w/v KOH or conc. $H_3PO_4$ (pH decreases upon cooling to r.t.). The DO probe should read <10% throughout. Then, 400 mg (1.0 mmol; 5 mM) of Mohr's salt $(NH_4)_2Fe(SO_4)_2 \cdot 6 H_2O$ was added to the resulting solution to give a reddish-brown solution. The reddish-brown color should sustain for at least 6 hours when the reaction is under constant nitrogen sparge. 1.0 mL of Antifoam-204 (Aldrich #A6426) was added to the reddish-brown solution to give a reddish-brown cloudy/milky mixture, to this mixture was added within 2-5 minutes DSP (600 mg, Condition J or 1200 mg Conditions K and L) in 20 mL of 100 mM pH 6.3 K—$PO_4$ buffer to give ~200 mL of a reddish-brown cloudy/milky mixture. The fermentor was placed under automatic feedback DO (at 10% DO) control (variable agitation rate) by switching the incoming gas stream to air (100% DO=oxygen level in air saturated water) at a reaction temperature of 25° C. for about 24 hours.

At specified time points, 5 uL of the reaction mixture were aliquoted into a 96 deep well plate containing 200 ul/well of 5% sodium bicarbonate. A 200 uL volume of 10 mg/mL of dansyl chloride in MeCN was added to each well, the plate heat sealed, and then quickly spun to settle the reaction solution to the bottom of the well. The plate was then heated at 44-45° C. for 1 hour with 600 rpm shaking. After incubation, the plate was centrifuged for 1 min at 4000 rpm. A 20 μL aliquot of supernatant was transferred into a 96 well plate containing 140 ul of water per well for HPLC analysis.

Summary and Results for DSP Assay Condition J:

This DSP assay condition was carried out at 200 mL scale in a 500 mL jacketed BioStat "Q" fermentation reaction vessel with Rushton impeller, gas sparging loop, thermocouple and dissolved oxygen (DO) and pH probes. The reaction mixture comprised: 30 g/L substrate compound (2), 1.5 eq (350 mM) a-ketoglutaric acid; 0.3 eq (70 mM) L-ascorbic acid; 1 mM Mohr's salt; 100 mM potassium phosphate buffer pH=6.3 (pH adjusted with KOH), 3 g/L protein of DSP enzyme powder preparation. The fermentor was placed under automatic feedback DO (at 10% DO) control (variable agitation rate) by switching the incoming gas stream to air (100% DO=oxygen level in air saturated water) at a reaction temperature of 25 C for about 24 hours.

The results are shown in the following table. The relative activity of each variant was calculated as the percent (%) conversion of the product formed per % conversion of SEQ ID NO:4 (i.e., the reference sequence), under the specified reaction conditions. The percent (%) conversion was quantified by dividing the area of the product peak by the sum of the areas of the substrate, product and impurities/side product peaks as determined by HPLC analysis. The peak area of the undesired product peak (2S,3S)-hydroxypipecolic acid expressed as a percentage with respect to the peak area of the desired product (2S,5S)-hydroxypipecolic acid.

TABLE 6.1

Results for SPF Assay Condition J

| SEQ ID NO: | Amino Acid Differences (Relative to SEQ ID NO: 4) | Activity FIOPC | % Conv. | % (2S, 3S) vs (2S, 5S) |
|---|---|---|---|---|
| 4 | NA | NA | 40 | 13 |
| 44 | M151R/F176V | + | 47 | 13 |
| 436 | S30R/C37I/L76V/M151R/S160R/F176V | + | 60 | 13 |
| 600 | S30R/C37I/V97A/M151R/S160R/F176V | + | 76 | 7 |
| 604 | S30R/C37I/V57A/V97A/M151R/S160R/F176V | + | 67.4 | 5.1 |
| 646 | S30N/C37I/V57A/A62D/V97A/E114S/M151R/S160R/F176V/H271W/E273T | + | 70.1 | 1.1 |
| 810 | R26A/S30N/C37I/V57A/A62D/T82K/V97A/E114S/M151R/C158N/S160R/K161P/F176V/H271W/E273T | + | 75 | 0.7 |

Summary and Results for DSP Assay Condition K:

This DSP assay condition was carried out on 200 mL scale in a 500 mL jacketed BioStat "Q" fermentation reaction vessel with Rushton impeller, gas sparging loop, thermocouple and dissolved oxygen (DO) and pH probes. The reaction mixture comprised: 30 g/L substrate compound (1), 1.5 eq (350 mM) a-ketoglutaric acid; 0.3 eq (70 mM) L-ascorbic acid; 1 mM Mohr's salt; 100 mM potassium phosphate buffer pH=6.3 (pH adjusted with KOH), 6 g/L protein of DSP enzyme powder preparation. The fermentor was placed under automatic feedback DO (at 10% DO) control (variable agitation rate) by switching the incoming gas stream to air (100% DO=oxygen level in air saturated water) at a reaction temperature of 25 C for about 24 hours.

The results are shown in the following table. The relative activity of each variant was calculated as the percent (%) conversion of the product formed per % conversion of SEQ ID NO:4 (i.e., the reference sequence), under the specified reaction conditions. The percent (%) conversion was quantified by dividing the area of the product peak by the sum of the areas of the substrate, product and impurities/side product peaks as determined by HPLC analysis. The peak area of the undesired product peak (2S,3S)-hydroxypipecolic acid expressed as a percentage with respect to the peak area of the desired product (2S,5S)-hydroxypipecolic acid.

TABLE 6.2

Results for SPF Assay Condition K

| SEQ ID NO: | Amino Acid Differences (Relative to SEQ ID NO: 4) | Activity FIOPC | % Conv. | % (2S, 3S) vs (2S, 5S) |
|---|---|---|---|---|
| 4 | NA | NA | 60 | 13 |
| 44 | M151R/F176V | + | 90 | 13 |
| 436 | S30R/C37I/L76V/M151R/S160R/F176V | + | 92 | 13 |
| 600 | S30R/C37I/V97A/M151R/S160R/F176V | + | 95 | 7 |
| 604 | S30R/C37I/V57A/V97A/M151R/S160R/F176V | + | 79.7 | 1 |
| 646 | S30N/C37I/V57A/A62D/V97A/E114S/M151R/S160R/F176V/H271W/E273T | + | 96.4 | 0.8 |
| 810 | R26A/S30N/C37I/V57A/A62D/T82K/V97A/E114S/M151R/C158N/S160R/K161P/F176V/H271W/E273T | + | 94.9 | 0.7 |

Summary and Results for DSP Assay Condition L:

This DSP assay condition was carried out on 200 mL scale in a 500 mL jacketed BioStat "Q" fermentation reaction vessel with Rushton impeller, gas sparging loop, thermocouple and dissolved oxygen (DO) and pH probes. The reaction mixture comprised: 60 g/L substrate compound (1), 1.5 eq (350 mM) a-ketoglutaric acid; 0.3 eq (70 mM) L-ascorbic acid; 1 mM Mohr's salt; 100 mM potassium phosphate buffer pH=6.3 (pH adjusted with KOH), 6 g/L protein of DSP enzyme powder preparation. The fermentor was placed under steady air flow 0.4 SLPM air; 720 rpm (kLA~0.05/s) at a reaction temperature of 25° C. for about 24 hours.

The results are shown in the following table. The relative activity of each variant was calculated as the percent (%) conversion of the product formed per % conversion of SEQ ID NO:4 (i.e., the reference sequence), under the specified reaction conditions. The percent (%) conversion was quantified by dividing the area of the product peak by the sum of the areas of the substrate, product and impurities/side product peaks as determined by HPLC analysis. The peak area of the undesired product peak (2S,3S)-hydroxyipecolic acid expressed as a percentage with respect to the peak area of the desired product (2S,5S)-hydroxypipecolic acid.

TABLE 6.3

Results for SPF Assay Condition L

| SEQ ID NO: | Amino Acid Differences (Relative to SEQ ID NO: 4) | Activity FIOPC | % Conv. | % (2S, 3S) vs (2S, 5S) |
|---|---|---|---|---|
| 4 | NA | NA | NA | NA |
| 44 | M151R/F176V | NA | 30.1 | 12 |
| 436 | S30R/C37I/L76V/M151R/ S160R/F176V | + | 41.9 | 9.8 |
| 600 | S30R/C37I/V97A/M151R/ S160R/F176V | + | 44.5 | 5.0 |
| 604 | S30R/C37I/V57A/V97A/ M151R/S160R/F176V | + | 42.4 | 1 |
| 646 | S30N/C37I/V57A/A62D/ V97A/E114S/M151R/ S160R/F176V/H271W/ E273T | + | 43.3 | 0.7 |
| 810 | R26A/S30N/C37I/V57A/ A62D/T82K/V97A/E114S/ M151R/C158N/S160R/ K161P/F176V/H271W/ E273T | + | 64.3 | 0.8 |

Example 7

Process for "One-Pot" Synthesis of Compound (2) from L-Lysine

In this Example, processes for a "one-pot" synthesis of Compound (2) from L-lysine are described.

A 200 mL scale reaction using DSP enzyme powder was carried out in a 500 mL jacketed BioStat "Q" fermentation vessel with Rushton impeller, gas sparging loop, thermocouple and dissolved oxygen (DO) probe. The reaction mixture comprised: 68 g/L substrate compound, 1.2 eq α-ketoglutaric acid; 70 mM L-ascorbic acid; 2 mM Mohr's salt; 100 mM potassium phosphate buffer pH=7.3 (pH adjusted with KOH), 6 g/L protein of SEQ ID NO: 810 DSP enzyme powder preparation, 0.5 g/L NAD, 3 g/L protein of lysine cyclodeaminase SEQ ID NO: 1006. First, 140 mL of 100 mM potassium phosphate buffer, pH=7.3 was added to the reactor followed by 13.6 g (470 mmol) of L-Lysine (equivalent to ~60 g/L product at 100% conv.) and 16.3 g (112 mmol; 1.2 equiv.) of α-ketoglutaric acid to give a clear colorless solution (pH~3) in ~5 minutes. The pH was adjusted to 7.3 via 50 wt % KOH (~17 mL; exothermic to ~32-35° C.). After the reaction mixture cooled to ~22-24° C., to the reactor under nitrogen sparge (DO=0%) was added: 1 mL of Antifoam 204, 100 mg (~0.5 g/L based on final volume) of NAD, 0.6 g of SEQ ID NO: 1006 DSP (~3 g/L based on final volume) in 10 mL of 100 mM pH 7.3 potassium phosphate buffer to give a clear pale yellow solution (at t=1 and 2 h, 10 μL aliquots were taken and quenched with 700 μL of 5% NaHCO$_3$). After stirring under nitrogen for two hours, 2.8 g (14 mmol; 0.15 equiv.) of sodium ascorbate was added to the reaction mixture followed by 160 mg (0.4 mmol) of Mohr's salt ((NH$_4$)$_2$Fe (SO$_4$)$_2$*6 H$_2$O) to give a dark red solution (the pH of was re-adjusted to 7.3 if necessary) and 1.2 g of SEQ ID NO: 810 DSP was added (~6 g/L based on final volume) in 10 mL of 100 mM pH 7.3 potassium phosphate buffer to give a dark red murky solution. The agitation rate was increased to 720 rpm and the gas stream was changed to 0.4 SLPM of 60:40 Air/N$_2$.

At t=3, 16, 18, 20, 22, 24, 26, 40, 44 and 48 h, 10 μL aliquots were taken and quenched with 700 μL of 5% NaHCO$_3$. At t=16 and 26 h; added 160 mg (0.4 mmol) of Mohr's salt. At t=40 h, set agitation at 600 rpm and gas stream to 0.4 SLPM of 50:50 Air/N$_2$. The aliquots were treated with 500 μL of 10 g/L Dansyl chloride in acetonitrile at 50° C. for 1 h. After derivatization, the samples were centrifuged at 5000 rpm at room temperature for 3 minutes. A 50 μL of the resulting supernatant was taken and diluted with 200 μL of dH$_2$O for HPLC analysis. The results are shown in FIG. 1.

All publications, patents, patent applications and other documents cited herein are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (1009 sequences)

SEQ ID NO: 1 - DNA, 843 bp, Artificial Sequence
  proline hydorxylase Shinorizobium melioti
atgtctacgcatttccttggcaaggtcaaattcgacgaggccagattagccgaagatctgtctactttagaagtcgctgagttttctagtgcatattcggacttcgcttgtggaaagtgggaagcatgtgttttacgcaacagaacaggcatgcaagaagaagacattgtggtttctcacaatgcgcccgcattagcgacccctttatctaaatcactgccgtacttgaatgagcttgttgaaacacacttcgactgcagtgcggttagatatacgcgtatcgtgcgtgtctccgagaacgcctgcattatccctcatagtgattatttggagctcgatgaaacgttcacccggctgcacctcgtgttggatactaacagtggttgtgccaacactgaggaagataagatattccacatgggtctgggcgagatctggtttctggacgcaatgttacctcattctgctgcctgcttttctaaaactcctagactgcatctcatgatagattttgaagctaccgccttcccggaatccttcttacgcaatgtggaacagcctgtaactactcgcgacatggtagaccctcgtaaagaattgacggacgaagttatagaaggcattttagggttctccataatcatcagtgaagcgaattaccgcgagatcgtctctatcctggccaaattacacttcttttataaagcggactgtcggtccatgtatgattggcttaaagaaatatgtaaacgccggggagatcccgcgttgattgagaagacagcgagtctcgaacgtttctttttggggcatcgtgaacgcggagaagtaatgacgtattaa

SEQ ID NO: 2 - protein, 280 aa, Artificial Sequence [sequence omitted]

SEQ ID NO: 3 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 4 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 5 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 6 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 7 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccattggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 8 - protein, 280 aa, Artificial Sequence
  proline hydorxylase Shinorizobium melioti
MSSHFLGKVKFDEARLAEDLSTLSRREFSSAYSDFAIGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 9 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggacgttgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 10 - protein, 280 aa, Artificial Sequence
  proline hydorxylase Shinorizobium melioti
MSSHFLGKVKFDEARLAEDLSTLSRREFSSAYSDFACGRWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 11 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgttgcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 12 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSVACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 13 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgcccataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 14 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCAHTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 15 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacggttgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 16 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENGCLIPHSDYLELDEEFTRLHLVLDTNSGCANTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 17 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttacatgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagaattagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcgtttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 18 - protein, 280 aa, Artificial Sequence
  proline hydorxylase Shinorizobium melioti
MSSHFLGKVKFDEARLAEDLSTLSRREFSSAYSDFTCGKWELCVLRNRTGMQEEDIVVSHNAPALQTPLSKSLPYLNELVETHFDCSRVRYVRIVRISENACLIPHSDYLELDEEFTRLHLVLDTNSGCANTEEDKIFHLGLGEIWFLDAMLPHSAACFSKTPRLQLMIDFEATAFPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 19 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 20 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 21 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcggtggtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 22 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSVVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 23 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtatgcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 24 - protein, 280 aa, Artificial Sequence
  proline hydorxylase Shinorizobium melioti
MSSHFLGKVKFDEARLAEDLSTLSRREFSSAYSDFACGKWELCMLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 25 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcaactgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 26 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 27 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacagggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 28 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDREFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 29 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 30 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 31 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacatgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 32 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 33 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgacactgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 34 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 35 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaatctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 36 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 37 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagccatttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 38 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEPFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 39 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggtctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 40 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 41 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaaaggacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 42 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFERTAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 43 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaaactgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 44 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAKLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 45 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 46 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 47 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 48 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 49 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaaaacacagagaacgcggggaagtaatgacctactaa

SEQ ID NO: 50 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLKHRERGEVMTY

SEQ ID NO: 51 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatgattgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 52 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMIDPRKELTDEVIEGILGFSIIISEANYREIVSILAKLHFFYKADCRSMYDWLKEICKRRGDPALIEKTASLERFFLGHRERGEVMTY

SEQ ID NO: 53 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcatgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 54 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRERGEVMTY

SEQ ID NO: 55 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaaccaggggaagtaatgacctactaa

SEQ ID NO: 56 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREPGEVMTY

SEQ ID NO: 57 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacaaggggaagtaatgacctactaa

SEQ ID NO: 58 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREQGEVMTY

SEQ ID NO: 59 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaagaaggggaagtaatgacctactaa

SEQ ID NO: 60 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREEGEVMTY

SEQ ID NO: 61 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagttgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 62 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKASCRSMYDWLKEICKRRGDPALIEKTASLERFFLGHRERGEVMTY

SEQ ID NO: 63 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccacatgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 64 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKATCRSMYDWLKEICKRRGDPALIEKTASLERFFLGHRERGEVMTY

SEQ ID NO: 65 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 66 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKAKCRSMYDWLKEICKRRGDPALIEKTASLERFFLGHRERGEVMTY

SEQ ID NO: 67 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaaggcacagagaacgcggggaagtaatgacctactaa

SEQ ID NO: 68 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLRHRERGEVMTY

SEQ ID NO: 69 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgttgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 70 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKACCRSMYDWLKEICKRRGDPALIEKTASLERFFLGHRERGEVMTY

SEQ ID NO: 71 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagttcgcggggaagtaatgacctactaa

SEQ ID NO: 72 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 73 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaattgggggaagtaatgacctactaa

SEQ ID NO: 74 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRELGEVMTY

SEQ ID NO: 75 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaagcaggggaagtaatgacctactaa

SEQ ID NO: 76 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREAGEVMTY

SEQ ID NO: 77 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtttcaatactgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 78 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLDTNSGCFNTEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 79 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtttcaattctgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 80 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLDTNSGCFNSEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 81 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 82 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 83 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgctaatactgaagaggacaagatattccatctgggtctcggtgaaatatggttcttggatgcgatgctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 84 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAMLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 85 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaatcctgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttgtgcaccaactcaggttgtttcaatactgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 86 - protein, 280 aa, Artificial Sequence
  proline hydorxylase Shinorizobium melioti
MSSHFLGKVKFDEARLAEDLSTLSRREFSSAYSDFALGKWESCVLRNRTGMQEEDIVVSHNAPALQTPLSKSLPYLNELVETHFDCSRVRYVRIVRVSENACLIPHSDYLELDEEFTRLHLVLCTNSGCFNTEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 87 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgctaattctgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 88 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLDTNSGCANSEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 89 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccctgggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttgaataccaactcaggttgtgctaattctgaagaggacaagatattccatctgggtctcggtgaaatatggttcttggatgcgatgctgcctcatagtgcagcatgtttttctaagacgcctagactgatgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 90 - protein, 280 aa, Artificial Sequence
  proline hydorxylase Shinorizobium melioti
MSSHFLGKVKFDEARLAEDLSTLSRREFSSAYSDFALGKWELCVLRNRTGMQEEDIVVSHNAPALQTPLSKSLPYLNELVETHFDCSRVRYVRIVRVSENACLIPHSDYLELDEEFTRLHLVLNTNSGCANSEEDKIFHLGLGEIWFLDAMLPHSAACFSKTPRLMLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 91 - DNA, 843 bp, Artificial Sequence
  proline hydorxylase Shinorizobium melioti
atgtttagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 92 - protein, 280 aa, Artificial Sequence
  proline hydorxylase Shinorizobium melioti
MFSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 93 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaagtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 94 - protein, 280 aa, Artificial Sequence
  proline hydorxylase Shinorizobium melioti
MSSHFLGKVKFDEARLAEDLSTLSRREFSSAYSDFACGKWELCVLRNRTSMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 95 - DNA, 843 bp, Artificial Sequence
  proline hydorxylase Shinorizobium melioti
atgattagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 96 - protein, 280 aa, Artificial Sequence
  proline hydorxylase Shinorizobium melioti
MISHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 97 - DNA, 843 bp, Artificial Sequence
  proline hydorxylase Shinorizobium melioti
atggagagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 98 - protein, 280 aa, Artificial Sequence
  proline hydorxylase Shinorizobium melioti
MESHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 99 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 100 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDRVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 101 - DNA, 843 bp, Artificial Sequence
  proline hydorxylase Shinorizobium melioti
atgaatagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 102 - protein, 280 aa, Artificial Sequence
  proline hydorxylase Shinorizobium melioti
MNSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 103 - DNA, 843 bp, Artificial Sequence
  proline hydorxylase Shinorizobium melioti
atgagtagccactttctcggcaaagtgaatttcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 104 - protein, 280 aa, Artificial Sequence
  proline hydorxylase Shinorizobium melioti
MSSHFLGKVNFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 105 - DNA, 843 bp, Artificial Sequence
  proline hydorxylase Shinorizobium melioti
atgagtagccactttctcggcaaagtgaaattcgatgaagcatgtcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 106 - protein, 280 aa, Artificial Sequence
  proline hydorxylase Shinorizobium melioti
MSSHFLGKVKFDEACLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 107 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacagcaatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 108 - protein, 280 aa, Artificial Sequence
  proline hydorxylase Shinorizobium melioti
MSSHFLGKVKFDEARLAEDLSTLSRREFSSAYSDFACGKWELCVLRNRTAMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 109 - DNA, 843 bp, Artificial Sequence
  proline hydorxylase Shinorizobium melioti
atgagtagccactttctcggccaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttttcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 110 - protein, 280 aa, Artificial Sequence
  proline hydorxylase Shinorizobium melioti
MSSHFLGQVKFDEARLAEDLSTLSRREFSSAYSDFACGKWELCVLRNRTGMQEEDIVVSHNAPALQTPLSKSLPYLNELVETHFDCFRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 111 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagttgttcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 112 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSCSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 113 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttactttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 114 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYFNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 115 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgtgttcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 116 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCVRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 117 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttttcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 118 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCFRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 119 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcactggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 120 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNALALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 121 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttgtcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 122 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCCRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 123 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttatcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 124 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCYRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 125 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgtccgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 126 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCPRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 127 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgtctgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 128 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCLRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 129 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaattgctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 130 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAIALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 131 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacctttatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 132 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLYELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 133 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 134 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 135 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcatttgctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 136 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAFALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 137 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttggcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 138 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCWRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 139 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagtttgtacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 140 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVCTHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 141 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataactgtccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 142 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNCPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 143 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcacatgctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 144 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAHALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 145 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcagtggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 146 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAVALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 147 - DNA, 843 bp, Artificial Sequence
  proline hydorxylase Shinorizobium melioti
atgcatagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 148 - protein, 280 aa, Artificial Sequence
  proline hydorxylase Shinorizobium melioti
MHSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 149 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattattgtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 150 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIIVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 151 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttcttacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 152 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVLTHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 153 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtgtgtcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 154 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSVSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 155 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataactttccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 156 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNFPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 157 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtatttcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 158 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSISLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 159 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtgatgtcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 160 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVMSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 161 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 162 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 163 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgaccatgagtttaccagattgcatctggtcttggataccaactcaggttgtgccaataccgaagaggacaagatattccatctgggtctcggtgaaatatggttcttggatgcgcacctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgactgccggtcgatgtatgattggctgaaagaaatttgcaagagacggggagacccggcgcttattgaaaagacggcttcattggaacgcttctttttaggtcacagagaacgcggggaagtaatgacctactaa

SEQ ID NO: 164 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDHEFTRLHLVLDTNSGCANTEEDKIFHLGLGEIWFLDAHLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 165 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagccgtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagatatcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 166 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEPFTRLHLVLDTNSGCANTEEDKIFHLGLGEIWFLDAGLPHSAACFSKTPRYQLMIDFERTAVPESFLRNVEQPVTTRDMVDPRKELTDEVIEGILGFSIIISEANYREIVSILAKLHFFYKACCRSMYDWLKEICKRRGDPALIEKTASLERFFLGHRERGEVMTY

SEQ ID NO: 167 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccacctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 168 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSTCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKATCRSMYDWLKEICKRRGDPALIEKTASLERFFLRHRERGEVMTY

SEQ ID NO: 169 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcgtgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 170 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRERGEVMTY

SEQ ID NO: 171 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 172 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKACCRSMYDWLKEICKRRGDPALIEKTASLERFFLGHRERGEVMTY

SEQ ID NO: 173 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 174 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKAKCRSMYDWLKEICKRRGDPALIEKTASLERFFLRHRERGEVMTY

SEQ ID NO: 175 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcgtgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 176 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAQLPHSAACFSKTPRYQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRVRGEVMTY

SEQ ID NO: 177 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 178 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 179 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcttgtgccaataccgaagaggacaagatattccatctgggtctcggtgaaatatggttcttggatgcgggcctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 180 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSACANTEEDKIFHLGLGEIWFLDAGLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 181 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 182 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFERTAVPESFLRNVEQPVTTRDMVDPRKELTDEVIEGILGFSIIISEANYREIVSILAKLHFFYKACCRSMYDWLKEICKRRGDPALIEKTASLERFFLRHRERGEVMTY

SEQ ID NO: 183 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcttgtgccaataccgaagaggacaagatattccatctgggtctcggtgaaatatggttcttggatgcgcagctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctcctgccggtcgatgtatgattggctgaaagaaatttgcaagagacggggagacccggcgcttattgaaaagacggcttcattggaacgcttctttttaggtcacagagtgcgcggggaagtaatgacctactaa

SEQ ID NO: 184 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSACANTEEDKIFHLGLGEIWFLDAQLPHSAACFSKTPRLQLMIDFERTAVPESFLRNVEQPVTTRDMVDPRKELTDEVIEGILGFSIIISEANYREIVSILAKLHFFYKASCRSMYDWLKEICKRRGDPALIEKTASLERFFLGHRVRGEVMTY

SEQ ID NO: 185 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 186 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKADCRSMYDWLKEICKRRGDPALIEKTASLERFFLRHRVRGEVMTY

SEQ ID NO: 187 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 188 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAGLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 189 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 190 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 191 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 192 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKAKCRSMYDWLKEICKRRGDPALIEKTASLERFFLRHRERGEVMTY

SEQ ID NO: 193 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 194 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKAKCRSMYDWLKEICKRRGDPALIEKTASLERFFLGHRERGEVMTY

SEQ ID NO: 195 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagccgtttaccagattgcatatggtcttggataccaactcaggttgtgccaataccgaagaggacaagatattccatctgggtctcggtgaaatatggttcttggatgcgcagctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 196 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEPFTRLHMVLDTNSGCANTEEDKIFHLGLGEIWFLDAQLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 197 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 198 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKAKCRSMYDWLKEICKRRGDPALIEKTASLERFFLRHRERGEVMTY

SEQ ID NO: 199 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagatatcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 200 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAGLPHSAACFSKTPRYQLMIDFERTAVPESFLRNVEQPVTTRDMVDPRKELTDEVIEGILGFSIIISEANYREIVSILAKLHFFYKACCRSMYDWLKEICKRRGDPALIEKTASLERFFLRHRERGEVMTY

SEQ ID NO: 201 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagctgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 202 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFERTAVPESFLRNVEQPVTTRDMVDPRKELTDEVIEGILGFSIIISEANYREIVSILAKLHFFYKASCRSMYDWLKEICKRRGDPALIEKTASLERFFLRHRVRGEVMTY

SEQ ID NO: 203 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcttgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 204 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSACANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKASCRSMYDWLKEICKRRGDPALIEKTASLERFFLRHRERGEVMTY

SEQ ID NO: 205 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgaccgtgagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 206 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDREFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLRHRVRGEVMTY

SEQ ID NO: 207 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgaccgtccgtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 208 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDRPFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 209 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagatatcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccaaatgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 210 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAGLPHSAACFSKTPRYQLMIDFERTAVPESFLRNVEQPVTTRDMVDPRKELTDEVIEGILGFSIIISEANYREIVSILAKLHFFYKAKCRSMYDWLKEICKRRGDPALIEKTASLERFFLGHRVRGEVMTY

SEQ ID NO: 211 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 212 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLRHRVRGEVMTY

SEQ ID NO: 213 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcgtgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 214 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRVRGEVMTY

SEQ ID NO: 215 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagccgtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 216 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEPFTRLHLVLDTNSTCANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 217 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 218 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 219 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagctgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 220 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFERTAVPESFLRNVEQPVTTRDMVDPRKELTDEVIEGILGFSIIISEANYREIVSILAKLHFFYKASCRSMYDWLKEICKRRGDPALIEKTASLERFFLRHRVRGEVMTY

SEQ ID NO: 221 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 222 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 223 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 224 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKACCRSMYDWLKEICKRRGDPALIEKTASLERFFLGHRVRGEVMTY

SEQ ID NO: 225 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 226 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSGCANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKASCRSMYDWLKEICKRRGDPALIEKTASLERFFLRHRERGEVMTY

SEQ ID NO: 227 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagccgtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 228 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEPFTRLHLVLDTNSTCANTEEDKIFHLGLGEIWFLDAGLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 229 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccacctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 230 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKATCRSMYDWLKEICKRRGDPALIEKTASLERFFLRHRERGEVMTY

SEQ ID NO: 231 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 232 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLRHRERGEVMTY

SEQ ID NO: 233 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgcagctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccagctgccggtcgatgtatgattggctgaaagaaatttgcaagagacggggagacccggcgcttattgaaaagacggcttcattggaacgcttctttttacgtcacagagaacgcggggaagtaatgacctactaa

SEQ ID NO: 234 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDAQLPHSAACFSKTPRLQLMIDFEATAVPESFLRNVEQPVTTRDMVDPRKELTDEVIEGILGFSIIISEANYREIVSILAKLHFFYKASCRSMYDWLKEICKRRGDPALIEKTASLERFFLRHRERGEVMTY

SEQ ID NO: 235 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcttgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 236 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRVRGEVMTY

SEQ ID NO: 237 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgagcagtttaccagattgcatctggtcttggataccaactcaacctgtgccaataccgaagaggacaagatattccatctgggtctcggtgaaatatggttcttggatgcgaggctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 238 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYLNELVETHFDCSRVRYVRIVRVSENACLIPHSDYLELDEQFTRLHLVLDTNSTCANTEEDKIFHLGLGEIWFLDARLPHSAACFSKTPRLQLMIDFERTAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 239 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 240 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSTCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRVRGEVMTY

SEQ ID NO: 241 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgggcctgcctcatagtgcagcatgtttttctaagacgcctagactgcagctgatgattgacttcgaacgtacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttacgtcacagagtgcgcggggaagtaatgacctactaa

SEQ ID NO: 242 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAGLPHSAACFSKTPRLQLMIDFERTAVPESFLRNVEQPVTTRDMVDPRKELTDEVIEGILGFSIIISEANYREIVSILAKLHFFYKADCRSMYDWLKEICKRRGDPALIEKTASLERFFLRHRVRGEVMTY

SEQ ID NO: 243 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacaaagagtttaccagattgcatctggtcttggataccaactcaacctgtgccaataccgaagaggacaagatattccatctgggtctcggtgaaatatggttcttggatgcgggcctgcctcatagtgcagcatgtttttctaagacgcctagatttcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgcctgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 244 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDKEFTRLHLVLDTNSTCANTEEDKIFHLGLGEIWFLDAGLPHSAACFSKTPRFQLMIDFEATAVPESFLRNVEQPVTTRDMVDPRKELTDEVIEGILGFSIIISEANYREIVSILAKLHFFYKAACRSMYDWLKEICKRRGDPALIEKTASLERFFLGHRERGEVMTY

SEQ ID NO: 245 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtaaatcattgccttaccttaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcagctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagcctgctgccggtcgatgtatgattggctgaaagaaatttgcaagagacggggagacccggcgcttattgaaaagacggcttcattggaacgcttctttttaggccacagagtgcgcggggaagtaatgacctactaa

SEQ ID NO: 246 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYLNELVETHFDCSRVRYVRIVRVSENACLIPHSDYLELDEEFTRLHLVLDTNSGCANTEEDKIFHLGLGEIWFLDAQLPHSAACFSKTPRYQLMIDFEATAVPESFLRNVEQPVTTRDMVDPRKELTDEVIEGILGFSIIISEANYREIVSILAKLHFFYKACCRSMYDWLKEICKRRGDPALIEKTASLERFFLGHRVRGEVMTY

SEQ ID NO: 247 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcatttgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 248 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAFALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 249 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcatttgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaacctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 250 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAFALQTPLSKSLPYVNELVETHFDCSRVRYVRIVRVSENACLIPHSDYLELDEEFTRLHLVLDTNSGCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 251 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcacttgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaacctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 252 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNALALQTPLSKSLPYVNELVETHFDCSRVRYVRIVRVSENACLIPHSDYLELDEEFTRLHLVLDTNSGCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 253 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaacctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 254 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSTCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 255 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttgccgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaacctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 256 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCCRVRYVRIVRVSENACLIPHSDYLELDEEFTRLHLVLDTNSGCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 257 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaacataacaggcatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaacctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 258 - protein, 280 aa, Artificial Sequence
  proline hydorxylase Shinorizobium melioti
MSSHFLGKVKFDEARLAEDLSTLSRREFSSAYSDFACGKWELCVLRNITGMQEEDIVVSHNAPALQTPLSKSLPYVNELVETHFDCSRVRYVRIVRVSENACLIPHSDYLELDEEFTRLHLVLDTNSTCANTEEDKIFHLGLGEIWFLDANLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 259 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcacttgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 260 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNALALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 261 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 262 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 263 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaacagaacaggcatgcaagaagaggatattgtggtttcccataacgcagttgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 264 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAVALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 265 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaacctgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 266 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSTCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 267 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaacataacaggcatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 268 - protein, 280 aa, Artificial Sequence
  proline hydorxylase Shinorizobium melioti
MSSHFLGKVKFDEARLAEDLSTLSRREFSSAYSDFACGKWELCVLRNITGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 269 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcacatgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 270 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDRVVSHNAHALQTPLSKSLPYVNELVETHFDCSRVRYVRIVRVSENACLIPHSDYLELDEEFTRLHLVLDTNSGCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 271 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaattgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 272 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAIALQTPLSKSLPYVNELVETHFDCSRVRYVRIVRVSENACLIPHSDYLELDEEFTRLHLVLDTNSHCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 273 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacagcgatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 274 - protein, 280 aa, Artificial Sequence
  proline hydorxylase Shinorizobium melioti
MSSHFLGKVKFDEARLAEDLSTLSRREFSSAYSDFACGKWELCVLRNRTAMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 275 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 276 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSHCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 277 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 278 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 279 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaacaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 280 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSHCANTEQDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 281 - DNA, 843 bp, Artificial Sequence
  proline hydorxylase Shinorizobium melioti
atgagtagccactttctcggcaaagtgaaattcgatgaagcatgccttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 282 - protein, 280 aa, Artificial Sequence
  proline hydorxylase Shinorizobium melioti
MSSHFLGKVKFDEACLAEDLSTLSRREFSSAYSDFACGKWELCVLRNRTGMQEEDRVVSHNAPALQTPLSKSLPYVNELVETHFDCSRVRYVRIVRVSENACLIPHSDYLELDEEFTRLHLVLDTNSHCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 283 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaattgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 284 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAIALQTPLSKSLPYVNELVETHFDCSRVRYVRIVRVSENACLIPHSDYLELDEEFTRLHLVLDTNSGCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 285 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaattgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 286 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAIALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 287 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 288 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 289 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttggcgagtccgttacgttcgtattgtaagagtgagcgagaacgcgtgcctgataccacattcagattacctcgagcttgacgaggagtttaccagattgcatctggtcttggataccaactcacattgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 290 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCWRVRYVRIVRVSENACLIPHSDYLELDEEFTRLHLVLDTNSHCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 291 - DNA, 843 bp, Artificial Sequence
  proline hydorxylase Shinorizobium melioti
atgagtagccactttctcggcaaagtgaaattcgatgaagcatgccttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 292 - protein, 280 aa, Artificial Sequence
  proline hydorxylase Shinorizobium melioti
MSSHFLGKVKFDEACLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSHCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 293 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcacatgctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcacattgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 294 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAHALQTPLSKSLPYVNELVETHFDCSRVRYVRIVRVSENACLIPHSDYLELDEEFTRLHLVLDTNSHCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 295 - DNA, 843 bp, Artificial Sequence
  proline hydorxylase Shinorizobium melioti
atgagtagccactttctcggcaaagtgaaattcgatgaagcatgccttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggaccgtatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 296 - protein, 280 aa, Artificial Sequence
  proline hydorxylase Shinorizobium melioti
MSSHFLGKVKFDEACLAEDLSTLSRREFSSAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDRIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 297 - DNA, 843 bp, Artificial Sequence
  proline hydorxylase Shinorizobium melioti
atgagtagccactttctcggcaaagtgaaattcgatgaagcatgccttgcagaagacttgtctacgctgagtcgtcgtgaattttcctccgcgtatagtgattttgcctgcggaaaatgggaactgtgtgttcttagaaaccgtacaggtatgcaagaagaggatcgtgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 298 - protein, 280 aa, Artificial Sequence
  proline hydorxylase Shinorizobium melioti
MSSHFLGKVKFDEACLAEDLSTLSRREFSSAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 299 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtgttcttagaaaccgtacaggtatgcaagaagaggatattgtggtttcccataactgcccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 300 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNCPALQTPLSVSLPYVNELVETHFDCSRVRYVRIVRVSENACLIPHSDYLELDEEFTRLHLVLDTNSACANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 301 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 302 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 303 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 304 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNCPALQTPLSKSLPYVNELVETHFDCSRVRYVRIVRVSENACLIPHSDYLELDEEFTRLHLVLDTNSGCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 305 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 306 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 307 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattattgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 308 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIIVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 309 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 310 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 311 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 312 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 313 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 314 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 315 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtgttcttagaaaccgtacaggtatgcaagaagaggatattgtggtttcccataacgcaccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 316 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSVSLPYVNELVETHFDCSRVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 317 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 318 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNCPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 319 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 320 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNCPALQTPLSKSLPYVNELVETHFDCSRVRYVRIVRVSENACLIPHSDYLELDEEFTRLHLVLDTNSYCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 321 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 322 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 323 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 324 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNCPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 325 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 326 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 327 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtccgcttagaaaccgtacaggtatgcaagaagaggatattattgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 328 - protein, 280 aa, Artificial Sequence
  proline hydorxylase Shinorizobium melioti
MSSHFLGKVKFDEARLAEDLSTLSRREFSTAYSDFACGKWELCPLRNRTGMQEEDIIVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 329 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgttgtttcccataacttcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 330 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNFPALQTPLSKSLPYVNELVETHFDCSRVRYVRIVRVSENACLIPHSDYLELDEEFTRLHLVLDTNSYCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 331 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 332 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 333 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 334 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 335 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattattgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 336 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIIVSHNCPALQTPLSKSLPYVNELVETHFDCSRVRYVRIVRVSENACLIPHSDYLELDEEFTRLHLVLDTNSYCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 337 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 338 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 339 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttagtccacagagaacgcggggaagtaatgaccttctaa

SEQ ID NO: 340 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLVHRERGEVMTF

SEQ ID NO: 341 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcgccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 342 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSVSLPYVNELVETHFDCSRVRYVRIVRVSENACLIPHSDYLELDEEFTRLHLVLDTNSYCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 343 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgttgtttcccataacttcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 344 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNFPALQTPLSKSLPYVNELVETHFDCSRVRYVRIVRVSENACLIPHSDYLELDEEFTRLHLVLDTNSACANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 345 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgtggtttcccataacgcaccggctcttcagaccccgctgagttgctcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 346 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSCSLPYVNELVETHFDCSRVRYVRIVRVSENACLIPHSDYLELDEEFTRLHLVLDTNSACANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 347 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtccgcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 348 - protein, 280 aa, Artificial Sequence
  proline hydorxylase Shinorizobium melioti
MSSHFLGKVKFDEARLAEDLSTLSRREFSTAYSDFACGKWELCPLRNRTGMQEEDIVVSHNCPALQTPLSKSLPYVNELVETHFDCSRVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 349 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 350 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 351 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtgatgtcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 352 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVMSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 353 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 354 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 355 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaatgctggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 356 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGECWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 357 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 358 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 359 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 360 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 361 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 362 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 363 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 364 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSACANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 365 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtccgcttagaaaccgtacaggtatgcaagaagaggatattgttgtttcccataacttcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 366 - protein, 280 aa, Artificial Sequence
  proline hydorxylase Shinorizobium melioti
MSSHFLGKVKFDEARLAEDLSTLSRREFSRAYSDFACGKWELCPLRNRTGMQEEDIVVSHNFPALQTPLSKSLPYVNELVETHFDCSRVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 367 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtccgcttagaaaccgtacaggtatgcaagaagaggatattattgtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 368 - protein, 280 aa, Artificial Sequence
  proline hydorxylase Shinorizobium melioti
MSSHFLGKVKFDEARLAEDLSTLSRREFSTAYSDFACGKWELCPLRNRTGMQEEDIIVSHNAPALQTPLSKSLPYVNELVETHFDCSRVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 369 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 370 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNCPALQTPLSKSLPYVNELVETHFDCSRVRYVRIVRVSENACLIPHSDYLELDEEFTRLHLVLDTNSGCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 371 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 372 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 373 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 374 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 375 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgcctgcggaaaatgggaactgtgtgttcttagaaaccgtacaggtatgcaagaagaggatattgtggtttcccataacgcaccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 376 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSVSLPYVNELVETHFDCSRVRYVRIVRVSENACLIPHSDYLELDEEFTRLHLVLDTNSACANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 377 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcgccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaatgctggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 378 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGECWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 379 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgtggtttcccataacgcaccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttgaaaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 380 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSVSLPYVNELVETHFDCSRVRYVRIVRVSENACLIPHSDYLELDEEFTRLHLVLDTNSGCANTEEDKIFHLGLGEIWFLDARLPHSAACFEKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 381 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgttgtttcccataacgcgccggctcttcagaccccgctgagtaaatcattgccttacgtgaatgaattagttgagacacatttcgactgttcgtgggtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 382 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSWVRYVRIVRVSENACLIPHSDYLELDEEFTRLHLVLDTNSYCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 383 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgtggtttcccataacgcgccggctcttcagaccccgctgagttgctcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 384 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSCSLPYVNELVETHFDCSRVRYVRIVRVSENACLIPHSDYLELDEEFTRLHLVLDTNSYCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 385 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataacttcccggctcttcagaccccgctgagttgctcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 386 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNFPALQTPLSCSLPYVNELVETHFDCSRVRYVRIVRVSENACLIPHSDYLELDEEFTRLHLVLDTNSACANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 387 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagcgcgtatagtgattttgcctgcggaaaatgggaactgtgtgttcttagaaaccgtacaggtatgcaagaagaggatattgtggtttcccataacgcaccggctcttcagaccccgctgagtgtgtcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcatattgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 388 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSVSLPYVNELVETHFDCSRVRYVRIVRVSENACLIPHSDYLELDEEFTRLHLVLDTNSYCANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 389 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgtgggtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 390 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSWVRYVRIVRVSENACLIPHSDYLELDEEFTRLHLVLDTNSACANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 391 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccagggcgtatagtgattttgcctgcggaaaatgggaactgtgtgttcttagaaaccgtacaggtatgcaagaagaggatattgttgtttcccataactgcccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagcgtgtgccaataccgaagaggacaagatattccatctgggtctcggtgaaatatggttcttggatgcgaccctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 392 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNCPALQTPLSKSLPYVNELVETHFDCSRVRYVRIVRVSENACLIPHSDYLELDEEFTRLHLVLDTNSACANTEEDKIFHLGLGEIWFLDATLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 393 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggtttgcagaaaccgtacaggtatgcaagaagaggatattgtgatgtcccataacgcaccggctcttcagaccccgctgagtatttcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 394 - protein, 280 aa, Artificial Sequence
  proline hydorxylase Shinorizobium melioti
MSSHFLGKVKFDEARLAEDLSTLSRREFSSAYSDFACGKWELAVCRNRTGMQEEDIVMSHNAPALQTPLSISLPYVNELVETHFDCSRVRYVRIVRVSENACLIPHSDYLELDEEFTRLHLVLDTNSECANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 395 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtgatgtcccataacgcaccggctcttcagaccccgctgagtatttcattgccttacgtgaatgaattagttgagacacatttcgactgttcgcgtgtccgttactgccgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 396 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVMSHNAPALQTPLSISLPYVNELVETHFDCSRVRYCRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 397 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgtttgcagaaaccgtacaggtatgcaagaagaggatattgtgatgtcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 398 - protein, 280 aa, Artificial Sequence
  proline hydorxylase Shinorizobium melioti
MSSHFLGKVKFDEARLAEDLSTLSRREFSSAYSDFACGKWELCVCRNRTGMQEEDIVMSHNAPALQTPLSKSLPYVNELVETHFDCSRVRYVRIVRVSENACLIPHSDYLELDEEFTRLHLVLDTNSECANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 399 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccggctcttcagaccccgctgagtatttcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 400 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSISLPYVNELVETHFDCSRVRYVRIVRVSENACLIPHSDYLELDEEFTRLHLVLDTNSECANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 401 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 402 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSECANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 403 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtgatgtcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagagcgcatctggtcttggataccaactcaggttgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 404 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVMSHNAPALQTPLSKSLPYVNELVETHFDCSRVRYVRIVRVSENACLIPHSDYLELDEEFTRAHLVLDTNSGCANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 405 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagagcgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 406 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRAHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 407 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtatttcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 408 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSISLPYVNELVETHFDCSRVRYVRIVRVSENACLIPHSDYLELDEEFTRLHLVLDTNSECANTEEDKIFHLGLGEIWFLDARLPHSAACFSKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 409 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtatttcattgccttacgtgaatgaattagttgagacacatttcgactgttcgcgtgtccgttactgccgtattgtaagagtgagcgagaacgcgtgcctgataccacattcagattacctcgagcttgacgaggagtttaccagattgcatctggtcttggataccaactcagaatgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 410 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSISLPYVNELVETHFDCSRVRYCRIVRVSENACLIPHSDYLELDEEFTRLHLVLDTNSECANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 411 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgtttgcagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 412 - protein, 280 aa, Artificial Sequence
  proline hydorxylase Shinorizobium melioti
MSSHFLGKVKFDEARLAEDLSTLSRREFSSAYSDFACGKWELCVCRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 413 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagagcgcatctggtcttgcataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 414 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRAHLVLHTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 415 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgtttgcagaaaccgtacaggtatgcaagaagaggatattgtgatgtcccataacgcaccggctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 416 - protein, 280 aa, Artificial Sequence
  proline hydorxylase Shinorizobium melioti
MSSHFLGKVKFDEARLAEDLSTLSRREFSSAYSDFACGKWELCVCRNRTGMQEEDIVMSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 417 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtgatgtcccataacgcaccggctcttcagaccccgctgagtatttcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 418 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVMSHNAPALQTPLSISLPYVNELVETHFDCSRVRYVRIVRVSENACLIPHSDYLELDEEFTRLHLVLDTNSGCANTEEDKIFHLGLGEIWFLDARLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 419 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatcgtgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaacctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 420 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDKIFHLGLGEIWFLDANLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 421 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatcgtgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaagacagaatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 422 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDRIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 423 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttgccgtgtccgttacgttcgtattgtaagagtgagcgagaacgcgtgcctgataccacattcagattacctcgagcttgacgaggagtttaccagattgcatctggtcttggataccaactcaacctgtgccaataccgaagaagacagaatattccatctgggtctcggtgaaatatggttcttggatgcgaacctgcctcatagtgcagcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 424 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCCRVRYVRIVRVSENACLIPHSDYLELDEEFTRLHLVLDTNSTCANTEEDRIFHLGLGEIWFLDANLPHSAACFSKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 425 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcatatgtatgattggctgaaagaaatttgcaagagacggggagacccggatcttattgaaaagacggcttcattggaacgcttctttttaggccacagagaacgcggggaagtaatgacctactaa

SEQ ID NO: 426 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRYQLMIDFEATAVPESFLRNVEQPVTTRDMVDPRKELTDEVIEGILGFSIIISEANYREIVSILAKLHFFYKADCRHMYDWLKEICKRRGDPDLIEKTASLERFFLGHRERGEVMTY

SEQ ID NO: 427 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacggctgcctgataccacattcagattacctcgagcttgacgaggagtttaccagattgcatctggtcttggataccaactcaggttgtgccaataccgaagaggacaagatattccatctgggtctcggtgaaatatggttcttggatgcgactctgggccatagtgcggcatgtttttctaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcatatgtatgattggctgaaagaaatttgcaagagacggggagacccggcgcttattgaaaagacggcttcattggaacgcttctttattggccatagagaacgcggggaagtaatgacctactaa

SEQ ID NO: 428 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENGCLIPHSDYLELDEEFTRLHLVLDTNSGCANTEEDKIFHLGLGEIWFLDATLGHSAACFSKTPRYQLMIDFEATAVPESFLRNVEQPVTTRDMVDPRKELTDEVIEGILGFSIIISEANYREIVSILAKLHFFYKADCRHMYDWLKEICKRRGDPALIEKTASLERFFIGHRERGEVMTY

SEQ ID NO: 429 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaccctgcctcatagtgcagcatgttttcgtaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcatatgtatgattggctgaaagaaatttgcaagagacggggagacccggcgcttattgaaaagacggcttcattggaacgcttctttttaggccacagagaacgcggggaagtaatgacctactaa

SEQ ID NO: 430 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDATLPHSAACFRKTPRYQLMIDFEATAVPESFLRNVEQPVTTRDMVDPRKELTDEVIEGILGFSIIISEANYREIVSILAKLHFFYKADCRHMYDWLKEICKRRGDPALIEKTASLERFFLGHRERGEVMTY

SEQ ID NO: 431 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatcgtgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 432 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDRVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 433 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacggctgcctgataccacattcagattacctcgagcttgacgaggagtttaccagattgcatctggtcttggataccaactcaggttgtgccaataccgaagaggacaagatattccatctgggtctcggtgaaatatggttcttggatgcgaccctgcctcatagtgcagcatgttttcgtaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcatatgtatgattggctgaaagaaatttgcaagagacggggagacccggcgcttattgaaaagacggcttcattggaacgcttctttttaggccacagagaacgcggggaagtaatgacctactaa

SEQ ID NO: 434 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENGCLIPHSDYLELDEEFTRLHLVLDTNSGCANTEEDKIFHLGLGEIWFLDATLPHSAACFRKTPRYQLMIDFEATAVPESFLRNVEQPVTTRDMVDPRKELTDEVIEGILGFSIIISEANYREIVSILAKLHFFYKADCRHMYDWLKEICKRRGDPALIEKTASLERFFLGHRERGEVMTY

SEQ ID NO: 435 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 436 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 437 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggtttttctatcatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgaattggaacggttctttttaggccacagagaatatggggaagtaatgacctactaa

SEQ ID NO: 438 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTAELERFFLGHREYGEVMTY

SEQ ID NO: 439 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagatatcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 440 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRYQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 441 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccatcggaagatgggaactgtgtgttcttagaaaccgtacaggtatgcaagaagaggatattgtggtttcccataactgcccagctcttcagaccccgctgagtaaatcattgccttacgtgaatgaattagttgagacacatttcgactgttcgcgtgtccgttacgttcgtattgtaagagtgagcgagaacggctgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 442 - protein, 280 aa, Artificial Sequence
  proline hydorxylase Shinorizobium melioti
MSSHFLGKVKFDEARLAEDLSTLSRREFSSAYSDFAIGRWELCVLRNRTGMQEEDIVVSHNCPALQTPLSKSLPYVNELVETHFDCSRVRYVRIVRVSENGCLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 443 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaagatgggaactgtgtgttcttagaaaccgtacaggtatgcaagaagaggatattgtggtttcccataactgcccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcatatgtatgattggctgaaagaaatttgcaagagacggggagacccggatcttattgaaaagacggcttcattggaacgcttctttttaggccacagagaacgcggggaagtaatgacctactaa

SEQ ID NO: 444 - protein, 280 aa, Artificial Sequence
  proline hydorxylase Shinorizobium melioti
MSSHFLGKVKFDEARLAEDLSTLSRREFSRAYSDFAIGRWELCVLRNRTGMQEEDIVVSHNCPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRHMYDWLKEICKRRGDPDLIEKTASLERFFLGHRERGEVMTY

SEQ ID NO: 445 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtgatgtcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgagtcatttttacggaacgttgaacagccggttaccacccgtgatatggtcgaccctagaaaagaattaacggacgaagtgatcgaaggtatactcggtttttctgaaatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttccttggaacagttctttttaggccacagagaatatggggaagtaatgacctactaa

SEQ ID NO: 446 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVMSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSEIISEANYREIVSILAKLHFFYKADCRSMYDWLKEICKRRGDPALIEKTASLEQFFLGHREYGEVMTY

SEQ ID NO: 447 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaccctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 448 - protein, 280 aa, Artificial Sequence
  proline hydorxylase Shinorizobium melioti
MSSHFLGKVKFDEARLAEDLSTLSRREFSRAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDATLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 449 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttccctgttcatatttacggaactttgaacagccggttaccacccgtgatatggtcgaccctagaaaagaattaacggacgaagtgatcgaaggtatactcggtttttctgaaatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgacttggaacggttctttttaggccacagagaacgcggggaagtaatgacctactaa

SEQ ID NO: 450 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPCSYLRNFEQPVTTRDMVDPRKELTDEVIEGILGFSEIISEANYREIVSILAKLHFFYKADCRSMYDWLKEICKRRGDPALIEKTADLERFFLGHRERGEVMTY

SEQ ID NO: 451 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatttcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaaccgggggaagtaatgacctactaa

SEQ ID NO: 452 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREPGEVMTY

SEQ ID NO: 453 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgccatcggaagatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 454 - protein, 280 aa, Artificial Sequence
  proline hydorxylase Shinorizobium melioti
MSSHFLGKVKFDEARLAEDLSTLSRREFSSAYSDFAIGRWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 455 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggaccgtatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 456 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDRIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 457 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaatatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacccgcggaagtaatgacctactaa

SEQ ID NO: 458 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDNIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREPAEVMTY

SEQ ID NO: 459 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 460 - protein, 280 aa, Artificial Sequence
  proline hydorxylase Shinorizobium melioti
MSSHFLGKVKFDEARLAEDLSTLSRREFSTAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 461 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactggcggttcttagaaaccgtacaggtatgcaagaagaggatattgtgatgtcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgagtcatatttacggaactttgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttccttggaacggttctttttaggccacagagaacgcggggaagtaatgacctactaa

SEQ ID NO: 462 - protein, 280 aa, Artificial Sequence
  proline hydorxylase Shinorizobium melioti
MSSHFLGKVKFDEARLAEDLSTLSRREFSSAYSDFACGKWELAVLRNRTGMQEEDIVMSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESYLRNFEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 463 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcctccgcgtatagtgattttgcctgcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacccggggaagtaatgaccctctaa

SEQ ID NO: 464 - protein, 280 aa, Artificial Sequence
  proline hydorxylase Shinorizobium melioti
MSSHFLGKVKFDEARLAEDLSTLSRREFSSAYSDFACGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHREPGEVMTL

SEQ ID NO: 465 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgagggttttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 466 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEGFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 467 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgcgcgtatagtgattttgcccttggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 468 - protein, 280 aa, Artificial Sequence
  proline hydorxylase Shinorizobium melioti
MSSHFLGKVKFDEARLAEDLSTLSRREFSRAYSDFALGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 469 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccgctgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 470 - protein, 280 aa, Artificial Sequence
  proline hydorxylase Shinorizobium melioti
MSSHFLGKVKFDEARLAEDLSTLSRREFSAAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 471 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccgaggcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 472 - protein, 280 aa, Artificial Sequence
  proline hydorxylase Shinorizobium melioti
MSSHFLGKVKFDEARLAEDLSTLSRREFSEAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 473 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtcttgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 474 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRLVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 475 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggagattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 476 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEEIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 477 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgaacttgacaatgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 478 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDNEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 479 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcggctgcctcatagtgcagcatgtttttgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 480 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFCKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 481 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaatgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 482 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 483 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgacgtcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 484 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVTSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 485 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaacgtgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 486 - protein, 280 aa, Artificial Sequence
  proline hydorxylase Shinorizobium melioti
MSSHFLGKVKFDEARLAEDLSTLSRREFSRAYSDFAIGTWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 487 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatactgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 488 - protein, 280 aa, Artificial Sequence
  proline hydorxylase Shinorizobium melioti
MSSHFLGKVKFDEARLAEDLSTLSRREFSRAYTDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 489 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaccgtgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 490 - protein, 280 aa, Artificial Sequence
  proline hydorxylase Shinorizobium melioti
MSSHFLGKVKFDEARLAEDLSTLSRREFSRAYSDFAIGPWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 491 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacagtgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 492 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 493 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgaccaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 494 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDQEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 495 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 496 - protein, 280 aa, Artificial Sequence
  proline hydorxylase Shinorizobium melioti
MSSHFLGKVKFDEARLAEDLSTLSRREFSTAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 497 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaaatgatgacctactaa

SEQ ID NO: 498 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEMMTY

SEQ ID NO: 499 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgggccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 500 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNGPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 501 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcggggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 502 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDAGLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 503 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaaaagatgacctactaa

SEQ ID NO: 504 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEKMTY

SEQ ID NO: 505 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccgttgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 506 - protein, 280 aa, Artificial Sequence
  proline hydorxylase Shinorizobium melioti
MSSHFLGKVKFDEARLAEDLSTLSRREFSVAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 507 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacacgccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 508 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNTPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 509 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacatgctgattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 510 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHADYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 511 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccggggcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 512 - protein, 280 aa, Artificial Sequence
  proline hydorxylase Shinorizobium melioti
MSSHFLGKVKFDEARLAEDLSTLSRREFSGAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 513 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacggtgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 514 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDGEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 515 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaaaggatgacctactaa

SEQ ID NO: 516 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGERMTY

SEQ ID NO: 517 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccatgatgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 518 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 519 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattattagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 520 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIIRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 521 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagagatgacctactaa

SEQ ID NO: 522 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEEMTY

SEQ ID NO: 523 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataaccggccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 524 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNRPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 525 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 526 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 527 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgcctgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 528 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVPENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 529 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtctgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 530 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCLNTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 531 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgagccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 532 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNEPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 533 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 534 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 535 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 536 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 537 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacatatggattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 538 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHMDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 539 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgccggaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 540 - protein, 280 aa, Artificial Sequence
  proline hydorxylase Shinorizobium melioti
MSSHFLGKVKFDEARLAEDLSTLSRREFSRAYSDFAIGKWELCVLRNRTGMPEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 541 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattttctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 542 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDFLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 543 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacggaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 544 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDGPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 545 - DNA, 843 bp, Artificial Sequence
  proline hydorxylase Shinorizobium melioti
atgagtagcccctttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacggaccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 546 - protein, 280 aa, Artificial Sequence
  proline hydorxylase Shinorizobium melioti
MSSPFLGKVKFDEARLAEDLSTLSRREFSRAYSDFAIGKWELCVLRNRTGMQEEDIVVSHDGPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 547 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacggaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 548 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNGPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 549 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaggaagaggatattgtggtttcccataacggaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 550 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNGPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 551 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 552 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 553 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacgcaccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 554 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDAPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 555 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtataccgattttgccatcggaaaatgggaactgtgtgttcttagaaaccgtacaggtatgcaagaagaggatattgtggtttcccataacggaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 556 - protein, 280 aa, Artificial Sequence
  proline hydorxylase Shinorizobium melioti
MSSHFLGKVKFDEARLAEDLSTLSRREFSRAYTDFAIGKWELCVLRNRTGMQEEDIVVSHNGPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 557 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacgaaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagagtgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 558 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDEPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 559 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacacgccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 560 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDTPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 561 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaggaagaggatattgtggtttcccatgacgaaccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 562 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDEPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 563 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacacgccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 564 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNTPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 565 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaggaagaggatattgtggtttcccataacaggccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagactgcatctggtcttggaaaccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 566 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNRPALQTPLSKSLPYVNELVETHFDCSRVRYVRIVRASENACLIPHSDYLELDEEFTRLHLVLETNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 567 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgaaccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 568 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNEPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 569 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgaaccagctcttcagaccccgctgagtaaatcattgccttacgtgaatgaattagttgagacacatttcgactgttcgcgtgtccgttacgttcgtcttgtaagagcgtcggagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 570 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNEPALQTPLSKSLPYVNELVETHFDCSRVRYVRLVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 571 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacggaccagctcttcagaccccgctgagtaaatcattgccttacgtgaatgaattagttgagacacatttcgactgttcgcgtgtccgttacgttcgtattgtaagagcgccggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 572 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNGPALQTPLSKSLPYVNELVETHFDCSRVRYVRIVRAPENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 573 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacacgccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 574 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNTPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 575 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgaaccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 576 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNEPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 577 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaggaagaggatattgtggtttcccataacacgccagctcttcagaccccgctgagtaaatcattgccttacgtgaatgaattagttgagacacatttcgactgttcgcgtgtccgttacgttcgtattgtaagagcgccggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 578 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNTPALQTPLSKSLPYVNELVETHFDCSRVRYVRIVRAPENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 579 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacaggccagctcttcagaccccgctgagtaaatcattgccttacgtgaatgaattagttgagacacatttcgactgttcgcgtgtccgttacgttcgtattgtaagagcgtcggagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 580 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNRPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 581 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacacgccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 582 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDTPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 583 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagagtgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 584 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 585 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagcgccggagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 586 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRAPENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 587 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacgcaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 588 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDAPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 589 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccatgacggaccagctcttcagaccccgctgagtaaatcattgccttacgtgaatgaattagttgagacacatttcgactgttcgcgtgtccgttacgttcgtattgtaagagcgccggagaacgcgtgcctgataccacattcagattacctcgagcttgacgaggagtttaccagactgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 590 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHDGPALQTPLSKSLPYVNELVETHFDCSRVRYVRIVRAPENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 591 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagcgattttgccatcggaaaatgggaactgtgtgttcttagaaaccgtacaggtatgcaagaagaggatattgtggtttcccataacaggccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 592 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNRPALQTPLSKSLPYVNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 593 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtataccgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagagtgcatctggtcttggataccaactcaggttgtgcgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagagaacgcggggaagtaatgacctactaa

SEQ ID NO: 594 - protein, 280 aa, Artificial Sequence
  proline hydorxylase Shinorizobium melioti
MSSHFLGKVKFDEARLAEDLSTLSRREFSRAYTDFAIGKWELCVLRNRTGMQEEDIVVSHNAPALQTPLSKSLPYVNELVETHFDCSRVRYVRIVRASENACLIPHSDYLELDEEFTRVHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 595 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtataccgattttgccatcggaaaatgggaactgtgtgttcttagaaaccgtacaggtatgcaagaagaggatattgtggtttcccatgacggaccagctcttcagaccccgctgagtaaatcattgccttacgtgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtttgaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccagagagaacgcggggaagtaatgacctactaa

SEQ ID NO: 596 - protein, 280 aa, Artificial Sequence
  proline hydorxylase Shinorizobium melioti
MSSHFLGKVKFDEARLAEDLSTLSRREFSRAYTDFAIGKWELCVLRNRTGMQEEDIVVSHDGPALQTPLSKSLPYVNELVETHFDCSRVRYVRIVRASENACLIPHSDYLELDEEFTRLHLVLDTNSGCLNTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGQRERGEVMTY

SEQ ID NO: 597 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccacggcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattattagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 598 - protein, 280 aa, Artificial Sequence
  proline hydorxylase Shinorizobium melioti
MSSHFLGKVKFDEARLAEDLSTLSRREFSTAYSDFAIGKWELCVLRNRTGMQEEDIVVSHNAPALQTPLSKSLPYVNELVETHFDCSRVRYVRIIRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 599 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 600 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYLNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 601 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgcgtctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaaatgatgacctactaa

SEQ ID NO: 602 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYLNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEMMTY

SEQ ID NO: 603 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgcggtttcccataacgcaccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 604 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIAVSHNAPALQTPLSKSLPYLNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 605 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgcggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 606 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIAVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 607 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgagtgttttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 608 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDECFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 609 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgctttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 610 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVLSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 611 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgagttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 612 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVSSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 613 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagagtcgattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 614 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEESIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 615 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgtattcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 616 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVYSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 617 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgtgttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 618 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVCSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 619 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgttgctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 620 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLLLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 621 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgcattcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 622 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVHSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 623 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgttgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 624 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLLIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 625 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgattattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 626 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLIIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 627 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtgaattcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 628 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVNSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 629 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattctggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 630 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDILVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 631 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgcggattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 632 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLRIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 633 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactggttctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 634 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLVLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 635 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgtggtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtagtgcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 636 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIVVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSSACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 637 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattactgtttcccataacgcaccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagaacgcggggaagtaatgacctactaa

SEQ ID NO: 638 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDITVSHNAPALQTPLSKSLPYVNELVETHFDCSRVRYVRIVRVSENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRERGEVMTY

SEQ ID NO: 639 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttcccgtgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagagaacgcggggaagtaatgacctactaa

SEQ ID NO: 640 - protein, 280 aa, Artificial Sequence
  proline hydorxylase Shinorizobium melioti
MSSHFLGKVKFDEARLAEDLSTLSRREFSRAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRERGEVMTY

SEQ ID NO: 641 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccatagaggacgcggggaagtaatgacctactaa

SEQ ID NO: 642 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNEPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGHRGRGEVMTY

SEQ ID NO: 643 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgtggtttcccataacgagccagctcttcagaccccgctgagtaaatcattgccttacgtgaatgaattagttgagacacatttcgactgttcgcgtgtccgttacgttcgtattgtaagagtgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccgtagaacgcgcggggaagtaatgacctactaa

SEQ ID NO: 644 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIVVSHNEPALQTPLSKSLPYVNELVETHFDCSRVRYVRIVRVSENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGRRTRGEVMTY

SEQ ID NO: 645 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 646 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 647 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccatgacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 648 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHDEPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 649 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccatgacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacaacgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagagaacgcggggaagtaatgacctactaa

SEQ ID NO: 650 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHDEPALQTPLSKSLPYLNELVETHFDCSRVRYVRIVRASENACLIPHSDYLELDNEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRERGEVMTY

SEQ ID NO: 651 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacaacgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagagaacgcggggaagtaatgacctactaa

SEQ ID NO: 652 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNEPALQTPLSKSLPYLNELVETHFDCSRVRYVRIVRASENACLIPHSDYLELDNEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRERGEVMTY

SEQ ID NO: 653 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccatgacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagagaacgcggggaagtaatgacctactaa

SEQ ID NO: 654 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHDDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRERGEVMTY

SEQ ID NO: 655 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacaacgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 656 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDNEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 657 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 658 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNEPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 659 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccatgacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacaacgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 660 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHDEPALQTPLSKSLPYLNELVETHFDCSRVRYVRIVRASENACLIPHSDYLELDNEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 661 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacgaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccgtagagaacgcggggaagtaatgacctactaa

SEQ ID NO: 662 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDEEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGRRERGEVMTY

SEQ ID NO: 663 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccatgacgagccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacaaggagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaggacgcggggaagtaatgacctactaa

SEQ ID NO: 664 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHDEPALQTPLSKSLPYLNELVETHFDCSRVRYVRIVRASENACLIPHSDYLELDKEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRGRGEVMTY

SEQ ID NO: 665 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggacgatgtatgattggctgaaagaaatttgcaagagacggggagacccggcgcttattgaaaagacggcttcattggaacgcttctttttaggctggagaacgcgcggggaagtaatgacctactaa

SEQ ID NO: 666 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRTMYDWLKEICKRRGDPALIEKTASLERFFLGWRTRGEVMTY

SEQ ID NO: 667 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgcgaaatcgtgtctattttagcgaagctgcacttcttttataaagccgattgccggcaaatgtatgattggctgaaagaaatttgcaagagacggggagacccggcgcttattgaaaagacggcttcattggaacgcttctttttaggctggagaacgcgcggggaagtaatgacctactaa

SEQ ID NO: 668 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRQMYDWLKEICKRRGDPALIEKTASLERFFLGWRTRGEVMTY

SEQ ID NO: 669 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaatgatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 670 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEMILGFSIIISEANYREIVSILAKLHFFYKADCRSMYDWLKEICKRRGDPALIEKTASLERFFLGWRTRGEVMTY

SEQ ID NO: 671 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttattacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 672 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVITRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 673 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtggtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 674 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 675 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaatggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 676 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRSMYDWLKEICKRRGDPALIEKTASLERFFLGWRTRGEVMTY

SEQ ID NO: 677 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcaatgttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 678 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESMLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 679 - DNA, 843 bp, Artificial Sequence
  proline hydorxylase Shinorizobium melioti
atgagtagccactttctcggcaaagtgaaattcgatgaagcacggcttgcagaagacttgtctacgctgacacgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 680 - protein, 280 aa, Artificial Sequence
  proline hydorxylase Shinorizobium melioti
MSSHFLGKVKFDEARLAEDLSTLTRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 681 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttcatacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 682 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVHTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 683 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 684 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 685 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 686 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 687 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcatgttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 688 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILMFSIIISEANYREIVSILAKLHFFYKADCRSMYDWLKEICKRRGDPALIEKTASLERFFLGWRTRGEVMTY

SEQ ID NO: 689 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacaggggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 690 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNRGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 691 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacacaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 692 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNTGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 693 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaatgtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 694 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIECILGFSIIISEANYREIVSILAKLHFFYKADCRSMYDWLKEICKRRGDPALIEKTASLERFFLGWRTRGEVMTY

SEQ ID NO: 695 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtcaaatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 696 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRQMVDPRKELTDEVIEGILGFSIIISEANYREIVSILAKLHFFYKADCRSMYDWLKEICKRRGDPALIEKTASLERFFLGWRTRGEVMTY

SEQ ID NO: 697 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgatttggaacgcttctttttaggctggagaacgcgcggggaagtaatgacctactaa

SEQ ID NO: 698 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTADLERFFLGWRTRGEVMTY

SEQ ID NO: 699 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtcaaggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 700 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGQGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 701 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccaccttggatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 702 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTLDMVDPRKELTDEVIEGILGFSIIISEANYREIVSILAKLHFFYKADCRSMYDWLKEICKRRGDPALIEKTASLERFFLGWRTRGEVMTY

SEQ ID NO: 703 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaagttttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 704 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKVLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 705 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagcgtcatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 706 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 707 - DNA, 843 bp, Artificial Sequence; identical to SEQ ID NO: 645
  proline hydorxylase Shinorizobium melioti

SEQ ID NO: 708 - protein, 280 aa, Artificial Sequence; identical to SEQ ID NO: 646
  proline hydorxylase Shinorizobium melioti

SEQ ID NO: 709 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacggccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 710 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 711 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacacaagttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 712 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATQVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 713 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccgattaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 714 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPITTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 715 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagtgtgttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 716 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQCVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 717 - DNA, 843 bp, Artificial Sequence
  proline hydorxylase Shinorizobium melioti
atgagtagccactttctcggcaaagtgaaattcgatgaagcacggcttgcagaagacttgtctacgctgtcgcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaaccgcggttgtgccaataccgaagaggacaagatattccatctgggtctcggtgaaatatggttcttggatgcgaggctgcctcatagtgcagcatgttttcgtggaacgcctagactgcagctgatgattgacttcgaagctacagcggttcccgaatcatttttacggaacgtcgaacagccgattcctacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 718 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNRGCANTEEDKIFHLGLGEIWFLDARLPHSAACFRGTPRLQLMIDFEATAVPESFLRNVEQPIPTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 719 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtggaacgcctagactgcagctgatgattgacttcgaagctacagcggttcccgaatcatttttacggaacgtcgaacagccggttcatacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 720 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRGTPRLQLMIDFEATAVPESFLRNVEQPVHTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 721 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaaccgcggttgtgccaataccgaagaggacaagatattccatctgggtctcggtgaaatatggttcttggatgcgaggctgcctcatagtgcagcatgttttcgtggaacgcctagactgcagctgatgattgacttcgaagctacagcggttcccgaatcatttttacggaacgtcgtacagccggttactacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 722 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNRGCANTEEDKIFHLGLGEIWFLDARLPHSAACFRGTPRLQLMIDFEATAVPESFLRNVVQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 723 - DNA, 843 bp, Artificial Sequence
  proline hydorxylase Shinorizobium melioti
atgagtagccactttctcggcaaagtgaaattcgatgaagcacggcttgcagaagacttgtctacgctgactcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactccggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttcatacccgttggatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 724 - protein, 280 aa, Artificial Sequence
  proline hydorxylase Shinorizobium melioti
MSSHFLGKVKFDEARLAEDLSTLTRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVHTRWMVDPRKELTDEVIEGILGFSIIISEANYREIVSILAKLHFFYKADCRSMYDWLKEICKRRGDPALIEKTASLERFFLGWRTRGEVMTY

SEQ ID NO: 725 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacagcggttgtgccaataccgaagaggacaagatattccatctgggtctcggtgaaatatggttcttggatgcgaggctgcctcatagtgcagcatgttttcgtggaacgcctagactgcagctgatgattgacttcgaagctacagcggttcccgaatcatttttacggaacgtcgtacagccggttcatacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 726 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRGTPRLQLMIDFEATAVPESFLRNVVQPVHTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 727 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtggaacgcctagactgcagctgatgattgacttcgaagctacagcggttcccgaatcatttttacggaacgtcgtacagccgattcatacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 728 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRGTPRLQLMIDFEATAVPESFLRNVVQPIHTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 729 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggatcatgtatgattggctgaaagaaatttgcaagagacggggagacccggcgcttattgaaaagacggcttcattggaacgcttctttttaggctggagaacgcgcggggaagtaatgacctactaa

SEQ ID NO: 730 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRIMYDWLKEICKRRGDPALIEKTASLERFFLGWRTRGEVMTY

SEQ ID NO: 731 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaaaggccggttatcacccgcgatatggtcgaccctagaaaagaattaacggacgaagtgatcgaaggtatactcggcttttctattatcatatcggaggcgaactaccgtgaaatcgtgtctatcttagcgaagctgcacttcttttataaagccgattgccggatcatgtatgattggctgaaagaaatttgcaagagacggggagacccggcgcttattgaaaagacggcttcattggaacgcttctttttaggctggagaacgcgcggggaagtaatgacctactaa

SEQ ID NO: 732 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVITRDMVDPRKELTDEVIEGILGFSIIISEANYREIVSILAKLHFFYKADCRIMYDWLKEICKRRGDPALIEKTASLERFFLGWRTRGEVMTY

SEQ ID NO: 733 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 734 - protein, 280 aa, Artificial Sequence; identical to SEQ ID NO: 668
  proline hydorxylase Shinorizobium melioti

SEQ ID NO: 735 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaagtcttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaagggccggttaccacccgtgatatagtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 736 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKVLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEGPVTTRDIVDPRKELTDEVIEGILGFSIIISEANYREIVSILAKLHFFYKADCRSMYDWLKEICKRRGDPALIEKTASLERFFLGWRTRGEVMTY

SEQ ID NO: 737 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacaaccggttaccacccgtgatatggtcgaccctagaaaagaattaacggacgaagtgatcgaaggtatactcatgttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 738 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILMFSIIISEANYREIVSILAKLHFFYKADCRQMYDWLKEICKRRGDPALIEKTASLERFFLGWRTRGEVMTY

SEQ ID NO: 739 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttccccgttcatttttacggaacctggaagggccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 740 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPRSFLRNLEGPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 741 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacagcggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaaaggccggttatcacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 742 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVITRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 743 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacagcggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggctggcttggaacgcttctttttaggctggagaacgcgcggggaagtaatgacctactaa

SEQ ID NO: 744 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRQMYDWLKEICKRRGDPALIEKTAGLERFFLGWRTRGEVMTY

SEQ ID NO: 745 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaagggccggttatcacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggatcatgtatgattggctgaaagaaatttgcaagagacggggagacccggcgcttattgaaaagacggcttcattggaacgcttctttttaggctggagaacgcgcggggaagtaatgacctactaa

SEQ ID NO: 746 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEGPVITRDMVDPRKELTDEVIEGILGFSIIISEANYREIVSILAKLHFFYKADCRIMYDWLKEICKRRGDPALIEKTASLERFFLGWRTRGEVMTY

SEQ ID NO: 747 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaacaaccggttaccacccgtgatatggtcgaccctagaaaagaattaacggacgaagtgatcgaaggtatactcatgttttctattatcatatcggaggcgaactaccgtgaaatcgtgtctatcttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 748 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEQPVTTRDMVDPRKELTDEVIEGILMFSIIISEANYREIVSILAKLHFFYKADCRQMYDWLKEICKRRGDPALIEKTASLERFFLGWRTRGEVMTY

SEQ ID NO: 749 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttatcacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggatcatgtatgattggctgaaagaaatttgcaagagacggggagacccggcgcttattgaaaagacggcttcattggaacgcttctttttaggctggagaacgcgcggggaagtaatgacctactaa

SEQ ID NO: 750 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVITRDMVDPRKELTDEVIEGILGFSIIISEANYREIVSILAKLHFFYKADCRIMYDWLKEICKRRGDPALIEKTASLERFFLGWRTRGEVMTY

SEQ ID NO: 751 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaagtcttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 752 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKVLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRQMYDWLKEICKRRGDPALIEKTASLERFFLGWRTRGEVMTY

SEQ ID NO: 753 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaacaccggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 754 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNTGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRQMYDWLKEICKRRGDPALIEKTASLERFFLGWRTRGEVMTY

SEQ ID NO: 755 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacaaccggttaccacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 756 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIERILGFSIIISEANYREIVSILAKLHFFYKADCRSMYDWLKEICKRRGDPALIEKTASLERFFLGWRTRGEVMTY

SEQ ID NO: 757 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaagggccggttatcacccgtgatatggtcgaccctagaaaagaattaacggacgaagtgatcgaaggtatactcggtttttctattatcatatcggaggcgaactaccgtgaaatcgtgtctattttagcgaagctgcacttcttttataaagccgattgccggcagatgtatgattggctgaaagaaatttgcaagagacggggagacccggcgcttattgaaaagacggcttcattggaacgcttctttttaggctggagaacgcgcggggaagtaatgacctactaa

SEQ ID NO: 758 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEGPVITRDMVDPRKELTDEVIEGILGFSIIISEANYREIVSILAKLHFFYKADCRQMYDWLKEICKRRGDPALIEKTASLERFFLGWRTRGEVMTY

SEQ ID NO: 759 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatacacagcggtgcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctggcttggaacgcttctttttaggctggagaacgcgcggggaagtaatgacctactaa

SEQ ID NO: 760 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESFLRNVEQPVTTRDMVDPRKELTDEVIEGILGFSIIISEANYREIVSILAKLHFFYKADCRSMYDWLKEICKRRGDPALIEKTAGLERFFLGWRTRGEVMTY

SEQ ID NO: 761 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtaaaacgcctagactgcagctgatgattgacttcgaagctacagcggtgcccgaatcatttttacggaacgtcgaacagcacgttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctggcttggaacgcttctttttaggctggagaacgcgcggggaagtaatgacctactaa

SEQ ID NO: 762 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQHVTTRDMVDPRKELTDEVIEGILGFSIIISEANYREIVSILAKLHFFYKADCRSMYDWLKEICKRRGDPALIEKTAGLERFFLGWRTRGEVMTY

SEQ ID NO: 763 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggtgcccgaatcatttttacggaacgtcgaacagcacgttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 764 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQHVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 765 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggtgcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctggcttggaacgcttctttttaggctggagaacgcgcggggaagtaatgacctactaa

SEQ ID NO: 766 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTAGLERFFLGWRTRGEVMTY

SEQ ID NO: 767 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcgaagcccgaatcatttttacggaacgtcgaacagcacgttaccacccgtgatatggtcgaccctagaaaagaattaacggacgaagtgatcgaaggtatactcggcttttctattatcatatcggaagcgaactaccgtgaaatcgtgtctattttagcgaagctgcacttcttttataaagccgattgccggtcgatgtatgattggctgaaagaaatttgcaagagacggggagacccggcgcttattgaaaagacggctggcttggaacgcttctttttaggctggagaacgcgcggggaagtaatgacctactaa

SEQ ID NO: 768 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAKPESFLRNVEQHVTTRDMVDPRKELTDEVIEGILGFSIIISEANYREIVSILAKLHFFYKADCRSMYDWLKEICKRRGDPALIEKTAGLERFFLGWRTRGEVMTY

SEQ ID NO: 769 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcgaagcccgaatcatttttacggaacgtcgaacagcacgttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 770 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAKPESFLRNVEQHVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 771 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatacacagcggtgcccgaatcatttttacggaacgtcgaacagcccgttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctagcttggaacgcttctttttaggctggagaacgcgcggggaagtaatgacctactaa

SEQ ID NO: 772 - protein, 280 aa, Artificial Sequence; identical to SEQ ID NO: 686
  proline hydorxylase Shinorizobium melioti

SEQ ID NO: 773 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgctttcgtcctacgcctagactgcagctgatgattgacttcgaatatacagcggttcccgaatcaatgttacggaacgtcgaacagccggttaccacccgtgatatggtcgaccctagagcagaattaacggacgaagtgatcgaaggcatactcggcttttctcttatcatatcggaggcgaactaccgtgaaatcgtgtctattttagcgaagctgcacttcgaatataaagccgattgccggaccatgtatgattggctgaaagaaatttgcaagagacggggagacccggcgcttattgaaaagacggcttcattggaacgcttctttttaggctggagaacgcgcggggaagtaatgacctactaa

SEQ ID NO: 774 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSACANTEEDKIFHLGLGEIWFLDARLPHSAACFRPTPRLQLMIDFEYTAVPESMLRNVEQPVTTRDMVDPRAELTDEVIEGILGFSLIISEANYREIVSILAKLHFEYKADCRTMYDWLKEICKRRGDPALIEKTASLERFFLGWRTRGEVMTY

SEQ ID NO: 775 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttctattataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 776 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFYYKADCRSMYDWLKEICKRRGDPALIEKTASLERFFLGWRTRGEVMTY

SEQ ID NO: 777 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 778 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESFLRNVEQPVATRDMVDPRKELTDEVIEGILGFSIIISEANYREIVSILAKLHFEYKADCRSMYDWLKEICKRRGDPALIEKTASLERFFLGWRTRGEVMTY

SEQ ID NO: 779 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgctttcgtaaaacgcctagactgcagctgatgattgacttcgaagcgacagcggttcccgaatcatttttacggaacgtcgaacagccggttaccacccgtgatatggtcgaccctagaaaagaattaacggacgaagtgatcgaaggtatactcggcttttctcttatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 780 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSACANTEEDKIFHLGLGEIWFLDARLPHSAACFRKTPRLQLMIDFEATAVPESFLRNVEQPVTTRDMVDPRKELTDEVIEGILGFSLIISEANYREIVSILAKLHFFYKADCRSMYDWLKEICKRRGDPALIEKTASLERFFLGWRTRGEVMTY

SEQ ID NO: 781 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtaaaacgcctagactgcagctgatgattgacttcgaaaagacagcggttcccgaatcatttttacggaacgtcgaacagccggttaccacccgtgatatggtcgaccctagaaaagaattaacggacgaagtgatcgaaggtatactcggcttttctcttatcatatcggaggcgaactaccgtgaaatcgtgtcgattttagcgaagctgcacttctattataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 782 - protein, 280 aa, Artificial Sequence
  proline hydorxylase Shinorizobium melioti
MSSHFLGKVKFDEARLAEDLSTLTRGEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEKTAVPESFLRNVEQPVTTRDMVDPRKELTDEVIEGILGFSLIISEANYREIVSILAKLHFYYKADCRSMYDWLKEICKRRGDPALIEKTASLERFFLGWRTRGEVMTY

SEQ ID NO: 783 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtaaaacgcctagactgcagctgatgattgacttcgaagcgacagcggttcccgaatcatttttacggaacgtcgaacagccggttaccacccgtcccatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggacctgttatgattggctgaaagaaatttgcaagagacggggagacccggcgcttattgaaaagacggcttcattggaacgcttctttttaggctggagaacgcgcggggaagtaatgacctactaa

SEQ ID NO: 784 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEATAVPESFLRNVEQPVTTRPMVDPRKELTDEVIEGILGFSIIISEANYREIVSILAKLHFFYKADCRTCYDWLKEICKRRGDPALIEKTASLERFFLGWRTRGEVMTY

SEQ ID NO: 785 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgctttcgtcctacgcctagactgcagctgatgattgacttcgaagcgacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 786 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRPTPRLQLMIDFEATAVPESFLRNVEQPVTTRDMVDPRKELTDEVIEGILGFSIIISEANYREIVSILAKLHFEYKADCRSMYDWLKEICKRRGDPALIEKTASLERFFLGWRTRGEVMTY

SEQ ID NO: 787 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgctttcgtcctacgcctagactgcagctgatgattgacttcgaagcgacagcggttcccgaatcaatgttacggaacgtcgaacagccggttaccacccgtgatatggtcgaccctagagcagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 788 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSACANTEEDKIFHLGLGEIWFLDARLPHSAACFRPTPRLQLMIDFEATAVPESMLRNVEQPVTTRDMVDPRAELTDEVIEGILGFSIIISEANYREIVSILAKLHFFYKADCRSMYDWLKEICKRRGDPALIEKTASLERFFLGWRTRGEVMTY

SEQ ID NO: 789 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 790 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVATRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 791 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 792 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 793 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcaaattttcgtaaaacgcctagactgcagctgatgattgacttcgaagcgacagcggttcccgaatcatttttacggaacgtcgaacagccggttaccacccgtgatatggtcgaccctagagcagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 794 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSACANTEEDKIFHLGLGEIWFLDARLPHSAANFRKTPRLQLMIDFEATAVPESFLRNVEQPVTTRDMVDPRAELTDEVIEGILGFSIIISEANYREIVSILAKLHFFYKADCRSMYDWLKEICKRRGDPALIEKTASLERFFLGWRTRGEVMTY

SEQ ID NO: 795 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtcccatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 796 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRPMVDPRKELTDEVIEGILGFSIIISEANYREIVSILAKLHFFYKADCRSMYDWLKEICKRRGDPALIEKTASLERFFLGWRTRGEVMTY

SEQ ID NO: 797 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtaaaacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 798 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 799 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcaatgttacggaacgtcgaacagccggttaccacccgtgatatggtcgaccctagaaaggaattaacggacgaagtgatcgaaaagatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 800 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSACANTEEDKIFHLGLGEIWFLDARLPHSAACFRKTPRLQLMIDFEATAVPESMLRNVEQPVTTRDMVDPRKELTDEVIEKILGFSIIISEANYREIVSILAKLHFFYKADCRSMYDWLKEICKRRGDPALIEKTASLERFFLGWRTRGEVMTY

SEQ ID NO: 801 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgctttcgtcctacgcctagactgcagctgatgattgacttcgaatatacagcggttcccgaatcaatgttacggaacgtcgaacagccggttaccacccgtgccatggtcgaccctagaaaggaattaacggacgaagtgatcgaaggcatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 802 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAACFRPTPRLQLMIDFEYTAVPESMLRNVEQPVTTRAMVDPRKELTDEVIEGILGFSIIISEANYREIVSILAKLHFEYKADCRSMYDWLKEICKRRGDPALIEKTASLERFFLGWRTRGEVMTY

SEQ ID NO: 803 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtaaaacgcctagactgcagctgatgattgacttcgaagcgacagcggttcccgaatcatttttacggaacgtcgaacagccggttgccacccgtgccatggtcgaccctagaaaagaattaacggacgaagtgatcgaaggtatactcggcttttctattatcatatcggaggcgaactaccgtgaaatcgtggcgattttagcgaagctgcacttcttttataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 804 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEATAVPESFLRNVEQPVATRAMVDPRKELTDEVIEGILGFSIIISEANYREIVAILAKLHFFYKADCRSMYDWLKEICKRRGDPALIEKTASLERFFLGWRTRGEVMTY

SEQ ID NO: 805 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 806 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 807 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtcctacgcctagactgcagctgatgattgacttcgaaaagacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggaccatgtatgattggctgaaagaaatttgcaagagacggggagacccggcgcttattgaaaagacggcttcattggaacgcttctttttaggctggagaacgcgcggggaagtaatgacctactaa

SEQ ID NO: 808 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRPTPRLQLMIDFEKTAVPESFLRNVEQPVTTRDMVDPRKELTDEVIEGILGFSIIISEANYREIVSILAKLHFFYKADCRTMYDWLKEICKRRGDPALIEKTASLERFFLGWRTRGEVMTY

SEQ ID NO: 809 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 810 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 811 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggacctgttatgattggctgaaagaaatttgcaagagacggggagacccggcgcttattgaaaagacggcttcattggaacgcttctttttaggctggagaacgcgcggggaagtaatgacctactaa

SEQ ID NO: 812 - protein, 280 aa, Artificial Sequence
  proline hydorxylase Shinorizobium melioti
MSSHFLGKVKFDEARLAEDLSTLTRGEFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSACANTEEDKIFHLGLGEIWFLDARLPHSAANFRPTPRLQLMIDFEATAVPESFLRNVEQPVATRDMVDPRKELTDEVIEGILGFSIIISEANYREIVSILAKLHFFYKADCRTCYDWLKEICKRRGDPALIEKTASLERFFLGWRTRGEVMTY

SEQ ID NO: 813 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtaaaacgcctagactgcagctgatgattgacttcgaatatacagcggttcccgaatcatttttacggaacgtcgaacagccggttaccacccgtgatatggtcgaccctagaaaagaattaacggacgaagtgatcgaaggtatactcggcttttctcttatcatatcggaggcgaactaccgtgaaatcgtgtctattttagcgaagctgcacttcttttataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 814 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEYTAVPESFLRNVEQPVTTRDMVDPRKELTDEVIEGILGFSLIISEANYREIVSILAKLHFFYKADCRSMYDWLKEICKRRGDPALIEKTASLERFFLGWRTRGEVMTY

SEQ ID NO: 815 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgctttcgtaaaacgcctagactgcagctgatgattgacttcgaagctacagcggttcccgaatcatttttacggaacgtcgaacagccggttaccacccgtgatatggtcgaccctagaaaagaattaacggacgaagtgatcgaaggcatactcggcttttctattatcatatcggaggcgaactaccgtgaaatcgtgtcgattttagcgaagctgcacttctattataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 816 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSACANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFYYKADCRSMYDWLKEICKRRGDPALIEKTASLERFFLGWRTRGEVMTY

SEQ ID NO: 817 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtcctacgcctagactgcagctgatgattgacttcgaagcgacagcggttcccgaatcaatgttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 818 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESMLRNVEQPVTTRDMVDPRKELTDEVIEGILGFSIIISEANYREIVSILAKLHFEYKADCRSMYDWLKEICKRRGDPALIEKTASLERFFLGWRTRGEVMTY

SEQ ID NO: 819 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgctttcgtaaaacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctcttatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 820 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSLIISEANYREIVSILAKLHFEYKADCRSMYDWLKEICKRRGDPALIEKTASLERFFLGWRTRGEVMTY

SEQ ID NO: 821 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagcgacagcggatcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 822 - protein, 280 aa, Artificial Sequence
  proline hydorxylase Shinorizobium melioti
MSSHFLGKVKFDEARLAEDLSTLTRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAANFRPTPRLQLMIDFEATADPESFLRNVEQPVTTRDMVDPRKELTDEVIEGILGFSIIISEANYREIVSILAKLHFEYKADCRSMYDWLKEICKRRGDPALIEKTASLERFFLGWRTRGEVMTY

SEQ ID NO: 823 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaaaacgcctagactgcagctgatgattgacttcgaatatacagcggttcccgaatcatttttacggaacgtcgaacagccggttaccacccgtgccatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggaccatgtatgattggctgaaagaaatttgcaagagacggggagacccggcgcttattgaaaagacggcttcattggaacgcttctttttaggctggagaacgcgcggggaagtaatgacctactaa

SEQ ID NO: 824 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEYTAVPESFLRNVEQPVTTRAMVDPRKELTDEVIEGILGFSIIISEANYREIVSILAKLHFFYKADCRTMYDWLKEICKRRGDPALIEKTASLERFFLGWRTRGEVMTY

SEQ ID NO: 825 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggatcccgaatcatttttacggaacgtcgaacagccggttaccacccgtgatatggtcgaccctagaaaagaattaacggacgaagtgatcgaaggtatactcggcttttctcttatcatatcggaggcgaactaccgtgaaatcgtgtctattttagcgaagctgcacttcttttataaagccgattgccggaccatgtatgattggctgaaagaaatttgcaagagacggggagacccggcgcttattgaaaagacggcttcattggaacgcttctttttaggctggagaacgcgcggggaagtaatgacctactaa

SEQ ID NO: 826 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSACANTEEDKIFHLGLGEIWFLDARLPHSAACFRKTPRLQLMIDFEYTADPESFLRNVEQPVTTRDMVDPRKELTDEVIEGILGFSLIISEANYREIVSILAKLHFFYKADCRTMYDWLKEICKRRGDPALIEKTASLERFFLGWRTRGEVMTY

SEQ ID NO: 827 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcaaattttcgtaaaacgcctagactgcagctgatgattgacttcgaagcgacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 828 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 829 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcagcctgtgccaataccgaagaggacaagatattccatctgggtctcggtgaaatatggttcttggatgcgaggctgcctcatagtgcagcatgttttcgtaagacgcctagactgcagctgatgattgacttcgaaaagacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtggcgattttagcgaagctgcacttcgaatataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 830 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSACANTEEDKIFHLGLGEIWFLDARLPHSAACFRKTPRLQLMIDFEKTAVPESFLRNVEQPVATRDMVDPRKELTDEVIEGILGFSIIISEANYREIVAILAKLHFEYKADCRSMYDWLKEICKRRGDPALIEKTASLERFFLGWRTRGEVMTY

SEQ ID NO: 831 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaaaagacagcggttcccgaatcaatgttacggaacgtcgaacagccggttaccacccgtgatatggtcgaccctagaaaagaattaacggacgaagtgatcgaaaggatactcggcttttctcttatcatatcggaggcgaactaccgtgaaatcgtggcgattttagcgaagctgcacttcgaatataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 832 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEKTAVPESMLRNVEQPVTTRDMVDPRKELTDEVIERILGFSLIISEANYREIVAILAKLHFEYKADCRSMYDWLKEICKRRGDPALIEKTASLERFFLGWRTRGEVMTY

SEQ ID NO: 833 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 834 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVATRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 835 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaaaagacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 836 - protein, 280 aa, Artificial Sequence
  proline hydorxylase Shinorizobium melioti
MSSHFLGKVKFDEARLAEDLSTLTRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEKTAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 837 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtaaaacgcctagactgcagctgatgattgacttcgaatatacagcggatcccgaatcaatgttacggaacgtcgaacagccggttgccacccgtcccatggtcgaccctagaaaagaattaacggacgaagtgatcgaaggtatactcggcttttctattatcatatcggaggcgaactaccgtgaaatcgtggcgattttagcgaagctgcacttcttttataaagccgattgccggagctgttatgattggctgaaagaaatttgcaagagacggggagacccggcgcttattgaaaagacggcttcattggaacgcttctttttaggctggagaacgcgcggggaagtaatgacctactaa

SEQ ID NO: 838 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTADPESMLRNVEQPVATRPMVDPRKELTDEVIEGILGFSIIISEANYREIVAILAKLHFFYKADCRSCYDWLKEICKRRGDPALIEKTASLERFFLGWRTRGEVMTY

SEQ ID NO: 839 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggccacagagcgcgcggggaagtaatgacctactaa

SEQ ID NO: 840 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVATRDMVDPRKELTDEVIEGILGFSIIISEANYREIVSILAKLHFFYKADCRSMYDWLKEICKRRGDPALIEKTASLERFFLGHRARGEVMTY

SEQ ID NO: 841 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtcctacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 842 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 843 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtaagacgcctagactgcagctgatgattgacttcgaaaagacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcgaatataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 844 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEKTAVPESFLRNVEQPVATRDMVDPRKELTDEVIEGILGFSIIISEANYREIVSILAKLHFEYKADCRSMYDWLKEICKRRGDPALIEKTASLERFFLGWRTRGEVMTY

SEQ ID NO: 845 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgctttcgtcctacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtggcgattttagcgaagctgcacttcttttataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 846 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRPTPRLQLMIDFEATAVPESFLRNVEQPVTTRDMVDPRKELTDEVIEGILGFSIIISEANYREIVAILAKLHFFYKADCRSMYDWLKEICKRRGDPALIEKTASLERFFLGWRTRGEVMTY

SEQ ID NO: 847 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggttcccgaatcaatgttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 848 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESMLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 849 - DNA, 843 bp, Artificial Sequence
  proline hydorxylase Shinorizobium melioti
atgagtagccactttctcggcaaagtgaaattcgatgaagcacggcttgcagaagacttgtctacgctgacccgtgcagaattttccaacgcgtatagtgattttgccatcggaaaatgggaactgtgtgttcttagaaaccgtacaggtatgcaagaagaggatattgcggtttcccataacgacccagctcttcagaccccgctgagtaaatatttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcagcttgtgccaataccgaagaggacaagatattccatctgggtctcggtgaaatatggttcttggatgcgaggctgcctcatagtgcagcatgttttcgtaaaacgcctagactgcagctgatgattgacttcgaagctacagcggttcccgaatcatttttacggaacgtcgaacagccggttgccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtgcatgtatgattggctgaaagaaatttgcaagagacggggagacccggcgcttattgaaaagacggcttcattggaacgcttctttttaggctggagaacgcgcggggaagtaatgacctactaa

SEQ ID NO: 850 - protein, 280 aa, Artificial Sequence
  proline hydorxylase Shinorizobium melioti
MSSHFLGKVKFDEARLAEDLSTLTRAEFSNAYSDFAIGKWELCVLRNRTGMQEEDIAVSHNDPALQTPLSKYLPYLNELVETHFDCSRVRYVRIVRASENACLIPHSDYLELDSEFTRLHLVLDTNSACANTEEDKIFHLGLGEIWFLDARLPHSAACFRKTPRLQLMIDFEATAVPESFLRNVEQPVATRDMVDPRKELTDEVIEGILGFSIIISEANYREIVSILAKLHFFYKADCRCMYDWLKEICKRRGDPALIEKTASLERFFLGWRTRGEVMTY

SEQ ID NO: 851 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaatatacagcggttcccgaatcaatgttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 852 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKELPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEYTAVPESMLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 853 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtcctacgcctagactgcagctgatgattgacttcgaagctacagcggttcccgaatcatttttacggaacgtcgaacagccggttgccacccgtcccatggtcgaccctagaaaagaattaacggacgaagtgatcgaaggtatactcggcttttctattatcatatcggaggcgaactaccgtgaaatcgtgtcgattttagcgaagctgcacttcgaatataaagccgattgccggaccatgtatgattggctgaaagaaatttgcaagagacggggagacccggcgcttattgaaaagacggcttcattggaacgcttctttttaggctggagaacgcgcggggaagtaatgacctactaa

SEQ ID NO: 854 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRPTPRLQLMIDFEATAVPESFLRNVEQPVATRPMVDPRKELTDEVIEGILGFSIIISEANYREIVSILAKLHFEYKADCRTMYDWLKEICKRRGDPALIEKTASLERFFLGWRTRGEVMTY

SEQ ID NO: 855 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtagagaattttccaacgcgtatagtgattttgccatcggaaaatgggaactgtgtgttcttagaaaccgtacaggtatgcaagaagaggatattgcggtttcccataacgacccagctcttcagaccccgctgagtaaagaattgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgctttcgtaaaacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctcttatcatatcggaggcgaactaccgtgaaatcgtgtctattttagcgaagctgcacttcgaatataaagccgattgccggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 856 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKELPYLNELVEKHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSLIISEANYREIVSILAKLHFEYKADCRSMYDWLKEICKRRGDPALIEKTASLERFFLGWRTRGEVMTY

SEQ ID NO: 857 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtggagaattttccaacgcgtatagtgattttgccatcggaaaatgggaactgtgtgttcttagaaaccgtacaggtatgcaagaagaggatattgcggtttcccataacgacccagctcttcagaccccgctgagtaaatatttgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtaaaacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 858 - protein, 280 aa, Artificial Sequence
  proline hydorxylase Shinorizobium melioti
MSSHFLGKVKFDEARLAEDLSTLSRGEFSNAYSDFAIGKWELCVLRNRTGMQEEDIAVSHNDPALQTPLSKYLPYLNELVETHFDCSRVRYVRIVRASENACLIPHSDYLELDSEFTRLHLVLDTNSGCANTEEDKIFHLGLGEIWFLDARLPHSAANFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 859 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctgggtgaaatatggttcttggatgcgaggctgcctcatagtgcagcatgttttcgtaagacgcctagactgcagctgatgattgacttcgaagctacccaagttcccgaatcattcttacggaacgtcgaacagccggttaccacccggcaaatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggcttcattggaacgcttctttttaggctggagaacgcgcggggaagtaatgacctactaa

SEQ ID NO: 860 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATQVPESFLRNVEQPVTTRQMVDPRKELTDEVIEGILGFSIIISEANYREIVSILAKLHFFYKADCRSMYDWLKEICKRRGDPALIEKTASLERFFLGWRTRGEVMTY

SEQ ID NO: 861 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggttccggtgaaatatggttcttggatgcgaggctgcctcatagtgcagcatgttttcgtaagacgcctagactgcagctgatgattgacttcgaagctacagcggttcccgaatcattcttacggaacgtcgaacagccggttaccacccggcaaatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgacttggaacgcttctttttaggctggagaacgcgcggggaagtaatgacctactaa

SEQ ID NO: 862 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGSGEIWFLDARLPHSAACFRKTPRLQLMIDFEATAVPESFLRNVEQPVTTRQMVDPRKELTDEVIEGILGFSIIISEANYREIVSILAKLHFFYKADCRSMYDWLKEICKRRGDPALIEKTADLERFFLGWRTRGEVMTY

SEQ ID NO: 863 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacgcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtcagggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggctgacttggaacgcttctttttaggctggagaacgcgcggggaagtaatgacctactaa

SEQ ID NO: 864 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGQGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTADLERFFLGWRTRGEVMTY

SEQ ID NO: 865 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctgggtgaaatatggttcttggatgcgaggctgcctcatagtgcagcatgttttcgtaagacgcctagactgcagctgatgattgacttcgaagctacagcggttcccgaatcattcttacggaacgtcgaacagccggttaccacccggcaaatggtcgaccctagaaaagaattaactgacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttccttggaacgcttctttttaggctggagaacgcgcggggaagtaatgacctactaa

SEQ ID NO: 866 - protein, 280 aa, Artificial Sequence; identical to SEQ ID NO: 696
  proline hydorxylase Shinorizobium melioti

SEQ ID NO: 867 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaatggatactcggattttctattatcatatcggaggcgaactaccgtgaaatcgtgtctattttagcgaagctgcacttcttttataaagcggattgtcggcgcatgtatgattggctgaaagaaatttgcaagagacggggagacccggcgcttattgaaaagacggctgacttggaacgcttctttttaggctggagaacgcgcggggaagtaatgacctactaa

SEQ ID NO: 868 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRRMYDWLKEICKRRGDPALIEKTADLERFFLGWRTRGEVMTY

SEQ ID NO: 869 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggttccggtgaaatatggttcttggatgcgaggctgcctcatagtgcagcatgtttccgtaagacgcctagactgcagctgatgattgacttcgaagctacccaagttcccgaatcaatgttacggaacgtcgaacagccggttaccacccgtgatatggtcgaccctagaaaagaattaactgacgaagtgatcgaatggatactcggattttctattatcatatcggaggcgaactaccgtgaaatcgtgtctattttagcgaagctgcacttcttttataaagccgattgccggtcgatgtatgattggctgaaagaaatttgcaagagacggggagacccgaggcttattgaaaagacggcttccttggaacgcttctttttaggctggagaacgcgcggggaagtaatgacctactaa

SEQ ID NO: 870 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGSGEIWFLDARLPHSAACFRKTPRLQLMIDFEATQVPESMLRNVEQPVTTRDMVDPRKELTDEVIEWILGFSIIISEANYREIVSILAKLHFFYKADCRSMYDWLKEICKRRGDPRLIEKTASLERFFLGWRTRGEVMTY

SEQ ID NO: 871 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaatggatactcggattttctattatcatatcggaggcgaactaccgtgaaatcgtgtctattttagcgaagctgcacttcttttataaatcggattgtcggagcatgtatgattggctgaaagaaatttgcaagagacggggagacccggcacttattgaaaagacggctgacttggaacgcttctttttaggctggagaacgcgcggggaagtaatgacctactaa

SEQ ID NO: 872 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKSDCRSMYDWLKEICKRRGDPALIEKTADLERFFLGWRTRGEVMTY

SEQ ID NO: 873 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgggacatggtcgaccctagaaaagaattaacggacgaagtgatcgaatggatactcggattttctattatcatatcggaggcgaactaccgtgaaatcgtgtctattttagcgaagctgcacttcttttataaagccgattgccggtcgatgtatgattggctgaaagaaatttgcaagagacggggagacccgaggcttattgaaaagacggctgacttggaacgcttctttttaggctggagaacgcgcggggaagtaatgacctactaa

SEQ ID NO: 874 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRSMYDWLKEICKRRGDPRLIEKTADLERFFLGWRTRGEVMTY

SEQ ID NO: 875 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacgcatttcgactgttcgcgtgtccgttacgttcgtattgtaagagcgagcgagaacgcgtgcctgataccacattcagattacctcgagcttgacagcgagtttaccagattgcatctggtcttggataccaactcattttgtgccaataccgaagaggacaagatattccatctgggtcagggtgaaatatggttcttggatgcgaggctgcctcatagtgcagcatgttttcgtaagacgcctagactgcagctgatgattgacttcgaagctacagcggttcccgaatcattcttacggaacgtcgaacagccggttaccaccctgcaaatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggctgacttggaacgcttctttttaggctggagaacgcgcggggaagtaatgacctactaa

SEQ ID NO: 876 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSFCANTEEDKIFHLGQGEIWFLDARLPHSAACFRKTPRLQLMIDFEATAVPESFLRNVEQPVTTLQMVDPRKELTDEVIEGILGFSIIISEANYREIVSILAKLHFFYKADCRSMYDWLKEICKRRGDPALIEKTADLERFFLGWRTRGEVMTY

SEQ ID NO: 877 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaaattgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaagggatactcggattttctattatcatatcggaggcgaactaccgtgaaatcgtgtctattttagcgaagctgcacttcttttataaagcggattgtcggagcatgtatgattggctgaaagaaatttgcaagagacggggagacccggcgcttattgaaaagacggcttcattggaacgcttctttttaggctggagaacgcgcggggaagtaatgacctactaa

SEQ ID NO: 878 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSNCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 879 - DNA, 843 bp, Artificial Sequence
  proline hydorxylase Shinorizobium melioti
atgagtagccactttctcggcaaagtgaaattcgataaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggttccggtgaaatatggttcttggatgcgaggctgcctcatagtgcagcatgttttcgtaagacgcctagactgcagctgatgattgacttcgaagctacccaagttcccgaatcaatgttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgacttggaacgcttctttttaggctggagaacgcgcggggaagtaatgacctactaa

SEQ ID NO: 880 - protein, 280 aa, Artificial Sequence
  proline hydorxylase Shinorizobium melioti
MSSHFLGKVKFDKARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGSGEIWFLDARLPHSAACFRKTPRLQLMIDFEATQVPESMLRNVEQPVTTRDMVDPRKELTDEVIEGILGFSIIISEANYREIVSILAKLHFFYKADCRSMYDWLKEICKRRGDPALIEKTADLERFFLGWRTRGEVMTY

SEQ ID NO: 881 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaatggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgacttggaacgcttctttttaggctggagaacgcgcggggaagtaatgacctactaa

SEQ ID NO: 882 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRSMYDWLKEICKRRGDPALIEKTADLERFFLGWRTRGEVMTY

SEQ ID NO: 883 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgacgagtcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcattcttacggaacgtcgaacagccggttaccaccctgcaaatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggctgacttggaacgcttctttttaggctggagaacgcgcggggaagtaatgacctactaa

SEQ ID NO: 884 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDESRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTLQMVDPRKELTDEVIEGILGFSIIISEANYREIVSILAKLHFFYKADCRSMYDWLKEICKRRGDPALIEKTADLERFFLGWRTRGEVMTY

SEQ ID NO: 885 - DNA, 843 bp, Artificial Sequence
  proline hydorxylase Shinorizobium melioti
atgagtagccactttctcggcaaagtgaaattcgataaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgacgagtcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgtttccgtaagacgcctagactgcagctgatgattgacttcgaagctacagcggttcccgaatcatttttacggaacgtcgaacagccggttaccacccgggacatggtcgaccctagaaaagaattaacggacgaagtgatcgaatggatactcggattttctattatcatatcggaggcgaactaccgtgaaatcgtgtctattttagcgaagctgcacttcttttataaagccgattgccggtcgatgtatgattggctgaaagaaatttgcaagagacggggagacccgaggcttattgaaaagacggctgacttggaacgcttctttttaggctggagaacgcgcggggaagtaatgacctactaa

SEQ ID NO: 886 - protein, 280 aa, Artificial Sequence
  proline hydorxylase Shinorizobium melioti
MSSHFLGKVKFDKARLAEDLSTLSRRTFSNAYSDFAIGKWELCVLRNRTGMQEEDIAVSHNDPALQTPLSKSLPYLNELVERHFDESRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRSMYDWLKEICKRRGDPRLIEKTADLERFFLGWRTRGEVMTY

SEQ ID NO: 887 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctgggtgaaatatggttcttggatgcgaggctgcctcatagtgcagcatgttttcgtaagacgcctagactgcagctgatgattgacttcgaagctaccgccgttcccgaatcaatgttacggaacgtcgaacagccggttaccacccggcaaatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggcttccttggaacgcttctttttaggctggagaacgcgcggggaagtaatgacctactaa

SEQ ID NO: 888 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATAVPESMLRNVEQPVTTRQMVDPRKELTDEVIEGILGFSIIISEANYREIVSILAKLHFFYKADCRSMYDWLKEICKRRGDPALIEKTASLERFFLGWRTRGEVMTY

SEQ ID NO: 889 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacccaagttcccgaatcaatgttacggaacgtcgaacagccggttaccacccgggacatggtcgaccctagaaaagaattaacggacgaagtgatcgaaggtatactcggcttttctattatcatatcggaggcgaactaccgtgaaatcgtgtctattttagcgaagctgcacttcttttataaagcggatactcggcgcatgtatgattggctgaaagaaatttgcaagagacggggagacccggcacttattgaaaagacggctgacttggaacgcttctttttaggctggagaacgcgcggggaagtaatgacctactaa

SEQ ID NO: 890 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSGCANTEEDKIFHLGLGEIWFLDARLPHSAACFRKTPRLQLMIDFEATQVPESMLRNVEQPVTTRDMVDPRKELTDEVIEGILGFSIIISEANYREIVSILAKLHFFYKADTRRMYDWLKEICKRRGDPALIEKTADLERFFLGWRTRGEVMTY

SEQ ID NO: 891 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccgaggcttattgaaaagacggcttccttggaacgcttctttttaggctggagaacgcgcggggaagtaatgacctactaa

SEQ ID NO: 892 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPRLIEKTASLERFFLGWRTRGEVMTY

SEQ ID NO: 893 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacgcatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcacttattgaaaagacggctgacttggaacgcttctttttaggctggagaacgcgcggggaagtaatgacctactaa

SEQ ID NO: 894 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTADLERFFLGWRTRGEVMTY

SEQ ID NO: 895 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtactttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcattttgtgccaataccgaagaggacaagatattccatctgggtctgggtgaaatatggttcttggatgcgaggctgcctcatagtgcagcatgtttccgtaagacgcctagactgcagctgatgattgacttcgaagctacagcggttcccgaatcatttttacggaacgtcgaacagccggttaccacccggcaaatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccgaggcttattgaaaagacggcttcattggaacgcttctttttaggctggagaacgcgcggggaagtaatgacctactaa

SEQ ID NO: 896 - protein, 280 aa, Artificial Sequence
  proline hydorxylase Shinorizobium melioti
MSSHFLGKVKFDEARLAEDLSTLSRRTFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSFCANTEEDKIFHLGLGEIWFLDARLPHSAACFRKTPRLQLMIDFEATAVPESFLRNVEQPVTTRQMVDPRKELTDEVIEGILGFSIIISEANYREIVSILAKLHFFYKADCRSMYDWLKEICKRRGDPRLIEKTASLERFFLGWRTRGEVMTY

SEQ ID NO: 897 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacgcatttcgacgagtcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaactgacgaagtgatcgaatggatactcggattttctattatcatatcggaagccaactaccgtgaaatcgtgtctattttagcgaagctgcacttcttttataaagcggattgtcggagcatgtatgattggctgaaagaaatttgcaagagacggggagacccggcacttattgaaaagacggctgacttggaacgcttctttttaggctggagaacgcgcggggaagtaatgacctactaa

SEQ ID NO: 898 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDESRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEWILGFSIIISEANYREIVSILAKLHFFYKADCRSMYDWLKEICKRRGDPALIEKTADLERFFLGWRTRGEVMTY

SEQ ID NO: 899 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaaagtgtgccaataccgaagaggacaagatattccatctgggttccggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaagggatactcggattttctattatcatatcggaagccaactaccgtgaaatcgtgtctattttagcgaagctgcacttcttttataaagccgattgccggtcgatgtatgattggctgaaagaaatttgcaagagacggggagacccgaggcttattgaaaagacggctgacttggaacgcttctttttaggctggagaacgcgcggggaagtaatgacctactaa

SEQ ID NO: 900 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSKCANTEEDKIFHLGSGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPRLIEKTADLERFFLGWRTRGEVMTY

SEQ ID NO: 901 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgagttttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggctgtgccaataccgaagaggacaagatattccatctgggtctcggtgaaatatggttcttggatgcgaggctgcctcatagtgcagcatgtttccgtaagacgcctagactgcagctgatgattgacttcgaagctacagcggttcccgaatcattcttacggaacgtcgaacagccggttaccaccctgcaaatggtcgaccctagaaaagaattaacggacgaagtgatcgaatggatactcggattttctattatcatatcggaggcgaactaccgtgaaatcgtgtctattttagcgaagctgcacttcttttataaagccgattgtcggagcatgtatgattggctgaaagaaatttgcaagagacggggagacccggcgcttattgaaaagacggctgacttggaacgcttctttttaggctggagaacgcgcggggaagtaatgacctactaa

SEQ ID NO: 902 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTLQMVDPRKELTDEVIEWILGFSIIISEANYREIVSILAKLHFFYKADCRSMYDWLKEICKRRGDPALIEKTADLERFFLGWRTRGEVMTY

SEQ ID NO: 903 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagaggcatttcgactgttcgcgtgtccgttacgttcgtattgtaagagcgagcgagaacgcgtgcctgataccacattcagattacctcgagcttgacagcgagtttaccagattgcatctggtcttggataccaactcattttgtgccaataccgaagaggacaagatattccatctgggtctgggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaagggatactcggattttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggctgacttggaacgcttctttttaggctggagaacgcgcggggaagtaatgacctactaa

SEQ ID NO: 904 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVERHFDCSRVRYVRIVRASENACLIPHSDYLELDSEFTRLHLVLDTNSFCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTADLERFFLGWRTRGEVMTY

SEQ ID NO: 905 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtcaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 906 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYRQIVSILAKLHFFYKADCRSMYDWLKEICKRRGDPALIEKTASLERFFLGWRTRGEVMTY

SEQ ID NO: 907 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgcacctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 908 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVAPRKELTDEVIEGILGFSIIISEANYREIVSILAKLHFFYKADCRSMYDWLKEICKRRGDPALIEKTASLERFFLGWRTRGEVMTY

SEQ ID NO: 909 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattggtaagacggcttcattggaacgcttctttttaggctggagaacgcgcggggaagtaatgacctactaa

SEQ ID NO: 910 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIGKTASLERFFLGWRTRGEVMTY

SEQ ID NO: 911 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgttggaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 912 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLLELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 913 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcgggtgcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 914 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISGANYREIVSILAKLHFFYKADCRSMYDWLKEICKRRGDPALIEKTASLERFFLGWRTRGEVMTY

SEQ ID NO: 915 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaagttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 916 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSSCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 917 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatagaaggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 918 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGIEGFSIIISEANYREIVSILAKLHFFYKADCRSMYDWLKEICKRRGDPALIEKTASLERFFLGWRTRGEVMTY

SEQ ID NO: 919 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtataggtggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 920 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGIGGFSIIISEANYREIVSILAKLHFFYKADCRSMYDWLKEICKRRGDPALIEKTASLERFFLGWRTRGEVMTY

SEQ ID NO: 921 - DNA, 843 bp, Artificial Sequence
  proline hydorxylase Shinorizobium melioti
atgagtagccactttctcggcaaagtgaaattcgatgaaggtcggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 922 - protein, 280 aa, Artificial Sequence
  proline hydorxylase Shinorizobium melioti
MSSHFLGKVKFDEGRLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 923 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctcgtatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 924 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSRIISEANYREIVSILAKLHFFYKADCRSMYDWLKEICKRRGDPALIEKTASLERFFLGWRTRGEVMTY

SEQ ID NO: 925 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaaggaacacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 926 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKEHFFYKADCRSMYDWLKEICKRRGDPALIEKTASLERFFLGWRTRGEVMTY

SEQ ID NO: 927 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtggtggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 928 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGGGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 929 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggagggtaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 930 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEGNYREIVSILAKLHFFYKADCRSMYDWLKEICKRRGDPALIEKTASLERFFLGWRTRGEVMTY

SEQ ID NO: 931 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttgttacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 932 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVVTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 933 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcggtcctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 934 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVGPRKELTDEVIEGILGFSIIISEANYREIVSILAKLHFFYKADCRSMYDWLKEICKRRGDPALIEKTASLERFFLGWRTRGEVMTY

SEQ ID NO: 935 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaagcaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 936 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKEATDEVIEGILGFSIIISEANYREIVSILAKLHFFYKADCRSMYDWLKEICKRRGDPALIEKTASLERFFLGWRTRGEVMTY

SEQ ID NO: 937 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattgtgtcgcttctttttaggctggagaacgcgcggggaagtaatgacctactaa

SEQ ID NO: 938 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLCRFFLGWRTRGEVMTY

SEQ ID NO: 939 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgatggtcggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 940 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADGRSMYDWLKEICKRRGDPALIEKTASLERFFLGWRTRGEVMTY

SEQ ID NO: 941 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacggaaagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 942 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTERLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 943 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatttatgattggctgaaagaaatttgcaagagacggggagacccggcgcttattgaaaagacggcttcattggaacgcttctttttaggctggagaacgcgcggggaagtaatgacctactaa

SEQ ID NO: 944 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSIYDWLKEICKRRGDPALIEKTASLERFFLGWRTRGEVMTY

SEQ ID NO: 945 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcgtatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 946 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIVSEANYREIVSILAKLHFFYKADCRSMYDWLKEICKRRGDPALIEKTASLERFFLGWRTRGEVMTY

SEQ ID NO: 947 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctggtatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 948 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSGIISEANYREIVSILAKLHFFYKADCRSMYDWLKEICKRRGDPALIEKTASLERFFLGWRTRGEVMTY

SEQ ID NO: 949 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggagtgtaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 950 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISECNYREIVSILAKLHFFYKADCRSMYDWLKEICKRRGDPALIEKTASLERFFLGWRTRGEVMTY

SEQ ID NO: 951 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgatagtcggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 952 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADSRSMYDWLKEICKRRGDPALIEKTASLERFFLGWRTRGEVMTY

SEQ ID NO: 953 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcggtttatgattggctgaaagaaatttgcaagagacggggagacccggcgcttattgaaaagacggcttcattggaacgcttctttttaggctggagaacgcgcggggaagtaatgacctactaa

SEQ ID NO: 954 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSVYDWLKEICKRRGDPALIEKTASLERFFLGWRTRGEVMTY

SEQ ID NO: 955 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcagttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 956 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGSSIIISEANYREIVSILAKLHFFYKADCRSMYDWLKEICKRRGDPALIEKTASLERFFLGWRTRGEVMTY

SEQ ID NO: 957 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcatgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 958 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSHVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 959 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggttcgcttctttttaggctggagaacgcgcggggaagtaatgacctactaa

SEQ ID NO: 960 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLVRFFLGWRTRGEVMTY

SEQ ID NO: 961 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgttacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtcgaacagccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 962 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVVTHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 963 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaaaggccggttaccacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 964 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVTTRDMVDPRKELTDEVIERILGFSIIISEANYREIVSILAKLHFFYKADCRSMYDWLKEICKRRGDPALIEKTASLERFFLGWRTRGEVMTY

SEQ ID NO: 965 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaaaggccggttaccacccgtgatatggtcgaccctagaaaagaattaacggacgaagtgatcgaaatgatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 966 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVTTRDMVDPRKELTDEVIEMILGFSIIISEANYREIVSILAKLHFFYKADCRSMYDWLKEICKRRGDPALIEKTASLERFFLGWRTRGEVMTY

SEQ ID NO: 967 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaaaggccggttaccacccgtgatatggtcgaccctagaaaagaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 968 - protein, 280 aa, Artificial Sequence; identical to SEQ ID NO: 710
  proline hydorxylase Shinorizobium melioti

SEQ ID NO: 969 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaaaggccggttatcacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 970 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVERPVITRDMVDPRKELTDEVIERILGFSIIISEANYREIVSILAKLHFFYKADCRSMYDWLKEICKRRGDPALIEKTASLERFFLGWRTRGEVMTY

SEQ ID NO: 971 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaagggccggttatcacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 972 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEGPVITRDMVDPRKELTDEVIERILGFSIIISEANYREIVSILAKLHFFYKADCRSMYDWLKEICKRRGDPALIEKTASLERFFLGWRTRGEVMTY

SEQ ID NO: 973 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaacaaccggttatcacccgtgatatggtcgaccctagaaaagaattaacggacgaagtgatcgaaatgatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 974 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEQPVITRDMVDPRKELTDEVIEMILGFSIIISEANYREIVSILAKLHFFYKADCRSMYDWLKEICKRRGDPALIEKTASLERFFLGWRTRGEVMTY

SEQ ID NO: 975 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaaaggccggttaccacccgtgatatggtcgaccctagaaaagaattaacggacgaagtgatcgaaatgatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 976 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLERPVTTRDMVDPRKELTDEVIEMILGFSIIISEANYREIVSILAKLHFFYKADCRSMYDWLKEICKRRGDPALIEKTASLERFFLGWRTRGEVMTY

SEQ ID NO: 977 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacgtggaagggccggttatcacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 978 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNVEGPVITRDMVDPRKELTDEVIERILGFSIIISEANYREIVSILAKLHFFYKADCRSMYDWLKEICKRRGDPALIEKTASLERFFLGWRTRGEVMTY

SEQ ID NO: 979 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaacaaccggttaccacccgtgatatggtcgaccctagaaaagaattaacggacgaagtgatcgaaaggatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 980 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEQPVTTRDMVDPRKELTDEVIERILGFSIIISEANYREIVSILAKLHFFYKADCRSMYDWLKEICKRRGDPALIEKTASLERFFLGWRTRGEVMTY

SEQ ID NO: 981 - DNA, 843 bp, Artificial Sequence
  proline hydorxylase Shinorizobium melioti
atgagtagccactttctcggcaaagtgaaattcgatgaagcacggcttgcagaagacttgtctacgctgagtcgtcgtgaattttccaacgcgtatagtgattttgccatcggaaaatgggaactgtgtgttcttagaaaccgtacaggtatgcaagaagaggatattgcggtttcccataacgacccagctcttcagaccccgctgagtaaatcattgccttacctgaatgaattagttgagacacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcatgttttcgtaagacgcctagactgcagctgatgattgacttcgaagctacagcggttcccgaatcatttttacggaacctggaacaaccggttatcacccgtgatatggtcgaccctagaaaagaattaacggacgaagtgatcgaaaagatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 982 - protein, 280 aa, Artificial Sequence
  proline hydorxylase Shinorizobium melioti
MSSHFLGKVKFDEARLAEDLSTLSRREFSNAYSDFAIGKWELCVLRNRTGMQEEDIAVSHNDPALQTPLSKSLPYLNELVETHFDCSRVRYVRIVRASENACLIPHSDYLELDSEFTRLHLVLDTNSGCANTEEDKIFHLGLGEIWFLDARLPHSAACFRKTPRLQLMIDFEATAVPESFLRNLEQPVITRDMVDPRKELTDEVIEKILGFSIIISEANYREIVSILAKLHFFYKADCRSMYDWLKEICKRRGDPALIEKTASLERFFLGWRTRGEVMTY

SEQ ID NO: 983 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtagtgcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 984 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSSANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 985 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatactgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 986 - protein, 280 aa, Artificial Sequence
  proline hydorxylase Shinorizobium melioti
MSSHFLGKVKFDEARLAEDLSTLSRAEFSNAYTDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 987 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattattagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 988 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIIRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 989 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtataaggattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 990 - protein, 280 aa, Artificial Sequence
  proline hydorxylase Shinorizobium melioti
MSSHFLGKVKFDEARLAEDLSTLSRAEFSNAYKDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 991 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtattgggattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 992 - protein, 280 aa, Artificial Sequence
  proline hydorxylase Shinorizobium melioti
MSSHFLGKVKFDEARLAEDLSTLSRAEFSNAYWDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 993 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaaactgaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 994 - protein, 280 aa, Artificial Sequence
  proline hydorxylase Shinorizobium melioti
MSSHFLGKVKFDEARLAEDLSTLSRAEFSNAYSDFAIGKTELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 995 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatggggattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 996 - protein, 280 aa, Artificial Sequence
  proline hydorxylase Shinorizobium melioti
MSSHFLGKVKFDEARLAEDLSTLSRAEFSNAYGDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 997 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaacaggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 998 - protein, 280 aa, Artificial Sequence
  proline hydorxylase Shinorizobium melioti
MSSHFLGKVKFDEARLAEDLSTLSRAEFSNAYSDFAIGKQELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 999 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgtggcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 1000 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSVANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 1001 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatagtgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagttttgcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 1002 - protein, 280 aa, Artificial Sequence
  proline hydorxylase Shinorizobium melioti
MSSHFLGKVKFDEARLAEDLSTLSRAEFSNAYSDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSFANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 1003 - DNA, 843 bp, Artificial Sequence
  proline hydorxylase Shinorizobium melioti
atgagtagccactttctcggcaaagtgaaattcgatgaagcacggcttgcagaagacttgtctacgctgagccgtgctgaattttccaacgcgtatcatgattttgccatcggaaaatgggaactgtgtgttcttagaaaccgtacaggtatgcaagaagaggatattgcggtttcccataacgacccagctcttcagaccccgctgagtaaatctttgccttacctgaatgaattagttgagaaacatttcgactgttcgcgtgtccgttacgttcgtattgtaagagcgagcgagaacgcgtgcctgataccacattcagattacctcgagcttgacagcgagtttaccagattgcatctggtcttggataccaactcaggttgtgccaataccgaagaggacaagatattccatctgggtctcggtgaaatatggttcttggatgcgaggctgcctcatagtgcagcaaattttcgtcctacgcctagactgcagctgatgattgacttcgaagctacagcggttcccgaatcatttttacggaacgtcgaacagccggttaccacccgtgatatggtcgaccctagaaaggaattaacggacgaagtgatcgaaggtatactcggcttttctattatcatatcggaggcgaactaccgtgaaatcgtgtctattttagcgaagctgcacttcttttataaagccgattgccggtcgatgtatgattggctgaaagaaatttgcaagagacggggagacccggcgcttattgaaaagacggcttcattggaacgcttctttttaggctggagaacgcgcggggaagtaatgacctactaa

SEQ ID NO: 1004 - protein, 280 aa, Artificial Sequence
  proline hydorxylase Shinorizobium melioti
MSSHFLGKVKFDEARLAEDLSTLSRAEFSNAYHDFAIGKWELCVLRNRTGMQEEDIAVSHNDPALQTPLSKSLPYLNELVEKHFDCSRVRYVRIVRASENACLIPHSDYLELDSEFTRLHLVLDTNSGCANTEEDKIFHLGLGEIWFLDARLPHSAANFRPTPRLQLMIDFEATAVPESFLRNVEQPVTTRDMVDPRKELTDEVIEGILGFSIIISEANYREIVSILAKLHFFYKADCRSMYDWLKEICKRRGDPALIEKTASLERFFLGWRTRGEVMTY

SEQ ID NO: 1005 - DNA, 1071 bp, Artificial Sequence
  lysine cyclodeaminase Agrobacterium tumefaciens
atgcccattgaccccaaattaaacgttgtaccttttatatctgttgaccacatgatgaaactggtgctgaaggtcggcattgatacctttctcaccgagttagctgcggagattgaaaaagacttccgccgttggcctatttttgacaagaaaccccgtgtcggtagtcattcgcaggacggggttatagagcttatgccgaccagtgacggttcattatatggatttaagtacgtcaacggccaccctaagaatacccatcaggggcggcaaacagtaacggcgttcggtgtgttgtccgatgtagggaatggctatcctctgttactctctgagatgactatattaactgccctgagaaccgcagctacgagcgctctggctgcaaaatatctggcgcggcccaatagtaaaacaatggccatcatcggaaatggtgcccagtccgaattccaggcgcgtgcttttcgtgcgatacttggaattcagaagctgcgcttgtttgacattgacactagcgcgacgagaaaatgtgctcgtaacttgacaggtcctgggttcgatatagtagagtgtgggagcgttgccgaggccgttgaaggtgcggacgtaattacgacagttacagcggacaagcagttcgcaacaattctgagtgataaccatgtaggtccaggcgtgcacataaatgccgttggtggagattgtcctggcaaaactgaaatttcaatggaagttctgttgcgctcagatattttcgtggagtacccaccgcagacatggatcgaaggcgatattcaacagttacctcgtacccacccagtgacggagttgtggcaagtaatgactggtgaaaaaacgggtcgggttggcgatagacagataactatgtttgattctgtgggattcgccatcgaagattttagtgccctgcgctacgtccgtgcaaaaattacggacttcgaaatgttcacagagttggaccttcttgctgatcctgacgaacctcgtgatctttatgggatgttgttgcgctgcgaaaagaaattagagcctacagcagtgggttaa

SEQ ID NO: 1006 - protein, 356 aa, Artificial Sequence
  lysine cyclodeaminase Agrobacterium tumefaciens
MPIDPKLNVVPFISVDHMMKLVLKVGIDTFLTELAAEIEKDFRRWPIFDKKPRVGSHSQDGVIELMPTSDGSLYGFKYVNGHPKNTHQGRQTVTAFGVLSDVGNGYPLLLSEMTILTALRTAATSALAAKYLARPNSKTMAIIGNGAQSEFQARAFRAILGIQKLRLFDIDTSATRKCARNLTGPGFDIVECGSVAEAVEGADVITTVTADKQFATILSDNHVGPGVHINAVGGDCPGKTEISMEVLLRSDIFVEYPPQTWIEGDIQQLPRTHPVTELWQVMTGEKTGRVGDRQITMFDSVGFAIEDFSALRYVRAKITDFEMFTELDLLADPDEPRDLYGMLLRCEKKLEPTAVG

SEQ ID NO: 1007 - DNA, 4095 bp, Artificial Sequence
  pJV110900
tcgagttaattaaggcagtgagcgcaacgcaattaatgtgagttagctcactcattaggcaccccaggctttacactttatgcttccggctcgtatgttgtgtggaattgtgagcggataacaatttcacacaggaaacggctatgaccatgattacggattcactggccgtcgttttacaatctagaggccagcctggccataaggagatatacatatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagagcgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgtttttttgcacaccatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggggccaaactggccaccatcaccatcaccattagggaagagcagatgggcaagcttgacctgtgaagtgaaaaatggcgcacattgtgcgacatttttttttgaattctacgtaaaaagcagccgatacatcggctgctttttttttctgcagggtgaaacaaaacggttaacaacatgaagtaaacacggtacggtgaaataagatcactccggggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaactgcaggagctcaaacagcagcctgtattcaggctgctttttagaaatattttatctgattaataagatgatcttcttgagatcgttttggtctgcgcgtattctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgaaccaccgctggtagcggtggtttttttaggcctatggccttttttttttgtgggaaacctttcgcggtatggtattaaagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgtttccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggttaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgtttc

SEQ ID NO: 1008 - DNA, 4095 bp, Artificial Sequence
  pJV110900 a18c RBS
tcgagttaattaaggcagtgagcgcaacgcaattaatgtgagttagctcactcattaggcaccccaggctttacactttatgcttccggctcgtatgttgtgtggaattgtgagcggataacaatttcacacaggaaacggctatgaccatgattacggattcactggccgtcgttttacaatctagaggccagcctggccataaggcgatatacatatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagagcgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgtttttttgcacaccatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggggccaaactggccaccatcaccatcaccattagggaagagcagatgggcaagcttgacctgtgaagtgaaaaatggcgcacattgtgcgacatttttttttgaattctacgtaaaaagcagccgatacatcggctgctttttttttctgcagggtgaaacaaaacggttaacaacatgaagtaaacacggtacggtgaaataagatcactccggggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaactgcaggagctcaaacagcagcctgtattcaggctgctttttagaaatattttatctgattaataagatgatcttcttgagatcgttttggtctgcgcgtattctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgaaccaccgctggtagcggtggtttttttaggcctatggccttttttttttgtgggaaacctttcgcggtatggtattaaagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgtttccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggttaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgtttc

SEQ ID NO: 1009 - DNA, 4095 bp, Artificial Sequence
  pJV110900 gc RBS
tcgagttaattaaggcagtgagcgcaacgcaattaatgtgagttagctcactcattaggcaccccaggctttacactttatgcttccggctcgtatgttgtgtggaattgtgagcggataacaatttcacacaggaaacggctatgaccatgattacggattcactggccgtcgttttacaatctagaggccagcctggccataagggcatatacatatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagagcgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgtttttttgcacaccatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggggccaaactggccaccatcaccatcaccattagggaagagcagatgggcaagcttgacctgtgaagtgaaaaatggcgcacattgtgcgacatttttttttgaattctacgtaaaaagcagccgatacatcggctgctttttttttctgcagggtgaaacaaaacggttaacaacatgaagtaaacacggtacggtgaaataagatcactccggggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaactgcaggagctcaaacagcagcctgtattcaggctgctttttagaaatattttatctgattaataagatgatcttcttgagatcgttttggtctgcgcgtattctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgaaccaccgctggtagcggtggtttttttaggcctatggccttttttttttgtgggaaacctttcgcggtatggtattaaagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgtttccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggttaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgtttc

What is claimed is:

1. An engineered polypeptide having proline hydroxylase activity comprises an amino acid sequence having at least 95% or more sequence identity to reference sequence SEQ ID NO:810 and one or more residue differences as compared to SEQ ID NO:810 at residue positions selected from: 2, 4, 8, 10, 15, 26, 30, 33, 36, 37, 39, 42, 43, 44, 45, 48, 50, 52, 55, 56, 57, 58, 61, 62, 63, 71, 76, 77, 81, 82, 87, 88, 92, 94, 95, 97, 98, 101, 107, 109, 114, 115, 119, 121, 124, 128, 130, 131, 132, 134, 136, 145, 151, 153, 156, 158, 160, 161, 165, 166, 168, 173, 176, 178, 180, 184, 194, 213, 230, 237, 240, 256, 263, 266, 269, 270, 271, 273, 274, 275, and 280.

2. The engineered polypeptide having proline hydroxylase activity of claim 1, wherein said one or more residue differences as compared to SEQ ID NO:810 is selected from the residue positions selected from: 33, 40, 95, 156, and 166.

3. The engineered polypeptide of claim 1, wherein said engineered polypeptide is capable of converting (S)-pipecolic acid to (2S,5S)-5-hydroxypipecolic acid.

4. The engineered polypeptide of claim 3, wherein said engineered polypeptide is capable of converting (S)-pipecolic acid to (2S,5S)-5-hydroxypipecolic acid with at least 1.2 fold, 1.5 fold, 2 fold, 3 fold, 4 fold, 5 fold, 10 fold, 20 fold, 30 fold, 40 fold, 50 fold, 60 fold, 70 fold, 80 fold, 90 fold, 100 fold or more enzymatic activity of the naturally occurring enzyme.

5. The engineered polypeptide of claim 3, wherein said engineered polypeptide is capable of converting (S)-pipecolic acid to (2S,5S)-5-hydroxypipecolic acid with greater than 90%, 91%, 92%, 93%, 94%, 95%, 96%, 97%, 98%, 99% or more diastereomeric excess of (2S,5R)-5-hydroxypipecolic acid.

* * * * *